United States Patent 10,240,205 (METHODS FOR ASSESSING RISK OF DEVELOPING A VIRAL DISEASE USING A GENETIC TEST) - sequence listing, part 2

SEQ ID NO: 79 - DNA, 307433 bp, Homo sapiens
cttcaataggatcagattagtttcatcagcatgcaaactatagtaacacctccatcctgaaaaagtctcatagatccctcatacacttccagccatcactacattttaatgaactaacagagactgatttctaggaggtactttttttttggcagggggacagagtctcgctgttgttggcctaggctggagcgcaatggcgcgatctcggctcactgcaacatccacctcccaggttccagcaattctcctgcctcagcctcccgagtagctgagattacaggtgcccaccaccacgccctgctaatttttgtatttttagtagagatgaggtttcatcatgttggccaggctggtctcgaactcctgacctcaggtgatccacccacctgggcctcccaaagtgctgggaagaggtattgttaactgcaaaaactcaagtgcaagaatatatataaaatgctactagcataagaaagattggaaatagttgaacaaataggtatagccttaattttgcagacagaaacatgaaggataatctagaaactaatgagactcactaacaccctcaagggtgggaactggagggaagagattagagggaggaagtgggtactgacacttctatgattatatctctttgaatagtttagacttctgaaaccatattaatatttcatatatcaaaataaaataaataggagtgaggaaacctaacattacctctaatgaataaaacacaaccacaataaagaaataacctaagtaactcttcacacaatatgtttagtattgtatattacagtattacataccttcagtccaaagatataaagtacagctactccttgacttgcaatggggttatatcccaataaactcatgggatgttgaaaatatcacaactggaaaatgcattttacagatgctcctcaacttaaaatggggttacaatttctactgaatgcgtatcacttttgcaccatcgtaaattgaaaaatcgctaagtcaaaccatcattaagtgagggactgtactgtcaataggtaataagctctggataaaaggtatgtttaccacagtggtatggatcagcaactctgaaattactttcagtaagttacaggattgagcaaatgagtcaatatactgcaggtactacaaatatggaaagggagaaggtaacaatgaaccctgtggtgataaactggaaatggaggtaacaatataaactcatggttttcaacatgtaagtacagaaatggttgtaaacatgtgtgtgtgaatatgtaatgtaatttatctacttatttcttaggtctgtcttgagaagcaaagacacccatgtaacagtgagcacatgttgtacccagatcttggttcttcaataccattccccactaataggaactaagaacttgcacctgtggctgcaatggagtaactggtactggatcccctccctcaaaatatatgaaatggctcagctattgatcaacaggcagtaaaagactaccatctgggatcctgtgactgtccctgttttcttcctgaagacacctgacagactggtagaaggcaggggtaccccaacaaagcactgtggtcttgctgatcgagatcagcgtgcagggaggctgaggtggctggaatttacagggcagataaatggaaaggtggggtaacctctcagaggaagagctccagtaaaatgcactagggttccctaatgcttaggctgaacagtaaactcccaattcatagaaaattactagagaaagaaaaaacaaccagggagctatgaaatgaacaaatcctagagattacactgagctgaaaggcattcacgctatgaccagcaggaatagagagaacttgtcaacacctatgtccagctggactgatcctccaggacagtaactaccttctgcagcaaaaccacactgaataagaaagatacctaataggcatgtgtcctatctgtcacaaaacaaaaccaattgacagttatttcacataattctaaagaaaaaaaattaccaaatgtttacagtcacaaaaaggtaacaaacataatatccattaatataaaatttaatgagtaaataatactggtattaatcatgttgcctttttctttagagaatgtaaaaatattgactacctccatctctttcaaccttattttaccccgaaaagcaatacattattcaaatgaaacttcaactcagggagtttttaagaaccataaacctcaagatcatcctaattggtgctggccttcaaatctagcattcacccaaatgacactatcactgaacaaaatacttctcaaactatgagttgtacaactgtttccagatcactcaccaagcacacaagaaaaaatgaacatttttatttttatgtcaagaaaaacagcctccatggccaagcctctccagcttcttcctgcaaagcccagtgtaactgacccctgctcctccagctggaacaaacagagaaaactggagtgtgaaccagaagacagcaaaaaacagcctgcaggccagtctgcacccagcttttacatcttttctaagggttgtaaagataaaacaaagaatatgtgacaaaaattgttaagaggcacacaaagcctaaaatatctggccttttacacacaaaatttactaacctcagtctagactaatgccagttcccagagaaagccctgagaaggcaaactactactgagtatcaatttccagaagcagactgacaaaaatctaattttttctaacttttgaagtctccctttctaactgccggagctctactcaagctgaccaaagttctagagctgaattccactcccctggcctcatgcaagaggggtctcctgcaggaaggaccccttccagcctcccactgcccacaatgctcacctcaccacataactgggcagccttggagaaaggggactgagagaaccacctaggctctctgaccagctgcccacccactagggggggcccattctctgctcaccccaacagaggcagctgtgctcctccaagacatcccttgtggtagcaggtgggagagagaacttgaagtccatctgggaacacatcaaagccatatctttgaaacaggtttaacggtaagtcataaagctaatgttttaatctccactggttaaatttactggtaccctagatacaaccttctatttataagactgacaatatctcaagaacaaatcactcttcttaaccacacaagccacctacgcatgctctgtatcaaagcttgttttatttaaccatgacattttgccaatgttacttcctcaacaaccaaaatggttcacagtcatcccatgaactatttgctaagtgccttctatgggccaggcactgttctggcaataggcctctgtcctaatgccaacgaaaggagcttatctgcgggggaggctgactgataatcaataagtaaaaaataaattcaagaacagaaacgttcagagatgaagctaaaatagaaaaatgtgatggaggctgggggaagcagggagacctgctttggtttaagtgatgagggaacagctatttaagatgacattagagcagaggcctttctgaacacaaagagaacactgagcacaacgagttggagagaagaatgagctttgtcaagcagagagagtaagaaaggcagtgggaaattggtgggaaaaggcaatgtggccagagtaggcgagacctgacacacttggtatcagtttcctggtgctgctggacaaataactacaagcttaaagggattacctgacaattctaggtcagaagtctaaaatgggttggcaaggctgcattccttctggaggcactagggaagatgagctcccttgcctttcccagcttctaggggctgtccacattccttggctcatggccccttccttgcttctctccaacttctgcttcctgttgtcatttctcctgctcagagtcctcctgcctccctcttgtatgaacccttgtctttacattgggcccagtggatacatcaggaaaatctccccatcgtaagatcttcaccttcctcacatctgcgaagttcctgtttccatgtaaggttccagcattaggacgtggacaactttgggggtcatttctgcctcccacacactttatttctgaacagtgtctgaaatagcagagtgatgtgatccattaacttttttaagatcacttgggctgctgtgtggggaaagggcaagagtggaagcagattagtcagcaggttattactaatatatatttcctattccttaaaatctctacagatcctaaaatattatacaggtaggctttttaaaaaatggaattagagtcagaaatgaattagcaacaaccaatcaatcattacttacacagaaagggcacgagtactctgagtcatttttaacggcatctctgacgtgctcaaatgaaaacattaaaatttaagtgcagctgacctttgaacaacatcaggtctatttgtacacagattttcttccacctctgccacccctttgagacagcaagacaacccctcctctttctccttaacctactcaacatgaagatgacaaggataacctgtgtgatgacccacttccacttgatagtaaatgtattttctcttccttatggttttcttagtaacattttcttttctttagcttactttactgtaagaataaagcatataatacatataacatacaaaatgtttgttactcaaccctttatgttaccagtgaggcctccagtcaacagtagactattagtagttcagtttttgagaagtcaagttataggaggattttcaactgtgaggggtgggggcaggggtgcaggtggaggtgtcatctctcctaacctctcatgttgctcaagggtcaactataagaaaagaagggcctcaaatcagttatctaaacttccaccttaggaagctagaaataagagtaaattaaacccgaggcaaacagagagaagaaaataatgaagaaatcaatgaatagaaagaaaagcaaaataaaggaaaccaaaagccacttatttgaaaagataaacaaaagtgactaatgttttgctagtatttaagaaaaaagacacaatgtatcaatatcaaaaataaataatcagacatcggccaggcacagtggctcacacctataatcccaacactttgggaggctgaggcaggcggccttgaggccaggagtccgagaccagcctggccaacatggtgaaaccccatctctactaaaaatacaaaaattagccaggtgtggtggtgcatgcctgtaatcccagctactcgggaggcggaggttgcagtgagctgagattacactgctgcactccagcctgggtgacagagcaagaccctgtctcaaaataaataaataaataatcaatcagatatcattatagattcaatgtagtaaaaggataaggaataatatgaacaattttatggcaattaacttgaaaacttagataaaacacaaattaccaaaactcactcaacttaaaagacacaaattaccaaaactcactcaaaaagaaatgtaaaccaaaaataaaattctgagttcgccaactgactgatggaccctcccctccaccaagggcaatccaaagctaacctgagaaactagttcaggccatgatggaaagtgggagtgggagtaggacattcttcattatactctcctcccgttggaattcaggcacagatgaccagcattaacatcaacacaggacctgaagactgacagaacaggccctttaagtctgacaagaaacatttacaatctattttctctgaagcttcccacctgaaggcttcatttgcataataagaaccttggtctccacaactaagacactgcctttcactgattccaggtctttagataaattctttcaaccaattgccaatcagaacatcactgaatctacctataacctggaaggccccctatccctcactgcttccagttgtcccacctgtccagactgaaccaacgtacatcttacatgtattgattgatgtcttatgtctccctaaaatgtataaaaccaagctgtagactgaacaccttgggcacacattctcatgatctcctggggctggtcactcatatttggctcagaataaatctcttcgaatatgttacagaatttgacttttcaaacagaagaaactcaagtagccctgtatttattaaagatatcaaattcatagttacaaatcttcccacaaagaaacttcctagaccaaatgacttcgttggtgaattttaccaaacaattaagtaagaaataataacaactatgcaaacttgttcagggaaatagaaggaaggaacatttcccaattcattttatgagaccagcactatcctgataccagaactacagaccttacaataaaagaaggcaaaccaatttcccttatgaaaagttataaaatcctaaaaaacttaagcaaatcaaatccagcagtatataaaaaggattaatgatcgagaggtctgttccaggaatacacaattgttaataattgataatcaatcaatcattcaccatattgacaggctgaaaaataatatgagaatcttaatagatgccaaaaagagatttgacaaaattcaatacatgttcatgaaaaaaaaaaaatgcctcagcaaactacaaataaaaagaaacttttcaccctgatgaactgcatctgtgaaaaaactacagctaacatcatacttagtagtaaaagactggatgccttccccataagattgagaaaagacaaagacgaacactcacactgcttttagtcaactctataatgaaaatgtaatggatatataaaaaaaaataaaaggtgaacagataggaaaggaagaagtaaaactatctttattcacaaatgacttgactacctttgtagaaaaccccagagtatctacaaaaaagagtcctagaagtaaaaagtgcatttaacaaggttgcaggatacaaagacaatatacaaaaatcaatatactagcaatatactagtaataaaaaattgggagtaaaattaagaagaaatgccacttacagtaacatcaaaatatatgaaaaacttagaaataaatttaaccaaacatgtctaagacctgaacatggtaacagacagtgcggtattggcattaaaaatacccagagaaggccaggcgtggtggctcacgcctgtaatcccagcactttgggaggccgaggcaggtggatcacgagatcaggagatcgagaccatcctggctaatacggtgaaaccccgtctctactaaaaatacaaaaaattagccgggcgtggtggcgagcccctgtagtcccagctactcgggaggctgaggcaggagaatggtgtgaacccaagaggtggagcttgcagtgagccaagatcacgccactgcactccagcctgggtgacagagtgagactccatcgcaaaaaaaaaaaaaaaaaagtacccagagaaccctgacataactcacacatatactgtcaactgatattttagacaggtcccaaaataatgtaatgggggaaaagttggtctgacaaatggtgctgggagaattgaaaatgcaacaaaacaaaaaccccaaaaaaagccacctgtgtataaaaaaaatacttcgtcgtttttattccaggttcctggcccaaagctcctaaaaccctcagaatttcctgagtgacagagtgtcttttgttattcctaacatgcccttctcaaccaaacctgagtttatgctaatgaactgactcttagagggcccctagatagctccaggacaggcgctggtcaccagaaatatcaagccatgatcagagggttagaactttcagtgccctacccacaccttcagggagtgagaggagctggagattgagctcagtcgccaatggctaatgatgtaatcaatcattatgtaaagaggcctccataaaaaatccctgaaacagggcttagggagctcccaggttagtgaacacatggatgtgctgggtaagtggcacacctggagagggtatggaagctctgcaaccctccaccctaactttgctctaagtacctcctccacttgactgttcctcagttttctcttttataataaactggtaatagtaaataaagcactttcctgagtttcgtgagatgctctagcaaatcccattcctgagaccaattatgacgtctttttttctaacaccacttctgacaccaaatgtctgagggtttccacaccaattcttcaacatcaagcgggtatccaacaattcagttaaattctgccaccatccaaaattagtgggatcccacaagttaaggggtcccacaaggctgccctcacttcagatgcaactcacaagtcccaggggcaacccatatgtctgaaacaaccagctatagatttggggattcccctaaactcctcaggttacttaattcactagaatgactcagaatttaaaaaaaaaaaaaaaacactttatttactatatgcaactcaggaacagaccaatggaacagatgcatagggcaaggtatgggaagagggagtacagagcttccatgccctctttaggagtgccaacctcctagaaaatcaatgtgttcaccaacctagaagctccctgagccccattttttgttttgtttttttgagacagggtctcactttgtcacccacgctggagcacagtggcacaatcacagctcactgcagcctcaatatctcaggctcaagcaatccttgcacctcagccccctcaagtagctgggattacaggaatgtgccaccacacccagttaagagggttttttgtttgtttgtttgtttgtttgtttgttttggtagagatggggttttgccatgttacccaggctggtctcaaactcaagccatccacctgcctcagcctcccaaagtggcagaattacaggcatgagccaccgtgcctggctctgaaccccgctgtttaagggtctttatggaggtttcattacctccatagggagacatgaatgactaaatcactggccactggtaactgagctgaatctctggcccctttcccctctggggggagagggtgctaaaagttctaatcctctaacccatggctgctttttctgacaagctgcccccccatcctgaagctatctagggtcatctcattacacaacaaaaagcacttggaccattcaggaaactcccagggttttaagagctctgtaccaagaacaagggcaaagaccaaatatattttttattctctttcacaacatatataaaaattaactcagaatacttcagagtcctaaatataagatataaaaactacaaaagtattagaaaacaggagaaaatctttctgactgtggggtaaaacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagtaattctacttctgactatttacctgagagaaataaaattatgcattgccaaaaaggtgtgtgtgaatggtcacagaagtgatgcataaaagccaaacgatggaaaaacccaaatgaccatcacctaatgaataaacaaaccgtgaaacagtcatacaataaatactattctcagcaataaaataaaatacatgccaataaaatgaaactagtgaaacatgaatatggatgaagctcaaaccattatgttaaatgaaagaggtcagacacaaaagactacccatagtatgagtcaatttattttaaaattacagaagatgctaaactaggagcagcaaggagattagtactttcagagatcagggcaagggaaggggcttgactgcaaatggacacaagaaaactttttaagtaacgaatatgttctgtatcatgattctgatcatggtttaaatacctgtcaaaattcatcaattatacattttaaattggtaaactttattccaagtaattcatacctaaataaaacattttttattccaacaaacaatatatgacaacaacaaaaaaacaaaaccctatatagctaaactaatacaaacttgttaaactactacaaatttgtggtatctatcccttcacgttacttatcaaactctctgaaggactaacagttaaatacataaatatgacaatctaagattctgaaacaacaacggccaggttacttcatagtccaacgtgcccacacatctatccagatcatgacatttttatccatatgaacagcacacaacattcaataatgcatgttgacaattttagtgacaagtcactctttagtcataacataatttactagaattcaaaagcagaagcaaaactacctttacttttttataaaacccacactggtgtaattcagtgaaacaatttagggttctacatatagcaatcaattaccaagaattgtttatcatatatcttaggaaatttcaaaagaaaaaatcctcattctcagtaatttctcacaaaatttcatttcaaaaatgttctggtaaaaacaatgcatgtgcactttgttactttgaattagaaaagtaaaagaacaaaaataaacagatgacggtgatttcacatttacatccaacgcagcagcccaatcagacttctttagaattttgtgattggcaaatattaaaattttaactacataaacattttgaaatagcagaattgttttgacttgtgtgtgtgtgtatgtgtgtgtgggtgtgtgtatgtaaggcagagagacagacacacacacacacacacacacacagagagaagagagagggagagggagagagagagaaggtaaactaaaagtgattaaacagtttttagaatatgtaaggaggcagcacacattcagtccaatctcacataatccatgtagccaatgcttcacaagaagctttgactaacaaaattatttttcttagtattctaagagaagtacaggcaagccatgaacccagaagtggtgttctaatctacaagaaagaatacacaacagtgattcccaacctgaagggtatgactgtgatcacacatttacatccaatgtagccggccaaccagaaagacttttccagaatgtcacgatcaacaatatattaaaatttggggtatagcacaccatgtgaaaacacattatgtatgggaaacactgtctgtatctgtgacaactatgacatatttttatctgtatttacatattactgtggttaatagaaacatccattttaatacattactgtaacaatgacattttgacattacacaccttctcaatgtagggccactaaaatgtctaagtgtataaaattttaagaactttaaagagacacctcatattccttctaggttctagattagaaaccacagtctaagagaaaactctgtcctaactgtcaagagaagtagtttcagctaagccaccacctttaaccaggtctttcacttcacagggattctataaaattaaagggtctgaattattctataggaactcttttagtctaaaatttatcttctcaaatgttgtaatgggtcgggcacagtggctcgcgcctgtaatcccagcactttgggaggccgaggcaggtggatcacttgaggtcaggagttcaaaaccagcctggccaacatggtgaaaccccgtctctactcaaaatacaaaaattagctgggcattgcagcaggtgcctgtaatcccagctactcgggaggctgaggcaggagaatcacctgaacctgaaagtcagaggttgcagtaagcagagatcataccactgcactccaacctgggtgacagaacatgatttcatctcaaaaaaaaaaaacaaaaagaaagttgtaacaacaatttaggaactcagttaatatcccaattttagtttccaaaaaaagaaaaatacactaatatactttgtatttttcaaaattatttactttgcatatatttgcttaatataatttgttaatataacgaagttatttcagaaagtttgaagacagaaaaaatatcacctttaatccatgatcttttttttttcattttttcaaacagggtctcgctctgtcacccaggctgaaatgcagtggcacaatcacggctcgcagctttgatcttccaagctcatgcgactctcccacctaagcctcctgagtagctaggactacaggcacgcaccaccatgcctggctaattttagtatatttttggagagacagggttttgccatgttgcccaggctggtcttgaactcctaggctcaagccaactgcctacctcggcctcccaaagtgctgggactacaggtgtgagccacctggcccatgaacttattggcacagacatagtttacacagctacagtaataatggccataacattttatatacaactctctctatgcttgtaacaggttattttccacactccatgtatatcactttataagtatcgtatttatatgtctttatatgtatgactttaaatatctacttaacattctaatgagcgcatcggtatataataagtcacttaaagagaacatcctggtagagtccttagaaaatttcatccttgtataaacatcattgagtatatatacacaaacctagatggtataggccaggggtccccaacccgagttgatgaatggtactggtctgtggcctgttaggaaccggtgacacagcaggaggtgagcacaggcaagggagcattactgcttgagctctgcctcctgtcagatcagcagccgcattagattctcataggagcacaaaccctaccgtgaactacgcatgcgagggatctaggttgcacgctccttatgagaatcaggccaaggtggcctgatgatctgagatggaacagtttcaccctgaaaccatcccctacataaataggatatatggtataacatatttctcttaggctacaaacctgtacagtgactgtattgaatgctgtaggtaactgtaacacaatgctaagtatttatatgtacctaaacagaaaacgtacagtaaaaatacagtattataatcttatgaggctgggcacagtggctcacccatgtaatctcagcactttgggaggcctaggcaggtggatcacctgaggtcaggagttcaagaccagcctgggcaacatggtaaaaaccccatctctactaaaattacaaaatttagctgggcatggtggcacacacctgtatcccagctactcaggagactgaggcacgagaatcgcttgaacactggaggcggaagttgcagtgagacaagatcacaccattgcactcctgcatgggtgacagggagaccccgtctcaaaaaaataaaaacaaataatcttatgggaccagcattgtataatgcaggctactgttaaccaaaatgttgttatggagcacatgactgtatttgtgtatatatatacatatatataaaataaagtaaaatactaggacaaaaataataattatttatattaggggatgaataaagtagaggaagtagggttagagagagttctctctgtatacattttcatacattttgacctaccatgctacttttttaaactaaaaattgattaaaaaacttaaaatgtaagtgaagtacttaataatgctaaataatagatttctgagaagtcagaaatcacttggcccaacctccaatgcaatgtaggaatctctttaatgtttatctgttttcctagcattttagaaaaaagatgtagccaaatttactatcagtaaataggagagtggtatgagacaattcagagaagctgcttattatatcccaaccattcctgaaaaaaatcagtgaattaaagcacagtttaaaggctgattaattccagcaaataaatgctgagtccctgttgtttgctgtgttctgagaatgtaaaagatgattctcaaagaataagaggagttcctatgctcaagaaatttgaggcaagaccatttgctaagctttaaatatttagaaatgagcaaggtatcactggaatacagtattaatatatacagagaaacctttgtgggagaagaaaaagaagagggaaaatgatgactttcaagggatggagaagaggctaaaaggataatcaataaacggtacactgtgtttttgaggtttcttttttttttgagccggagtctcacactgtcacccgggctggaatgaggtggcgtcatctcggctcactgcaacctctgcctcccaggttcaagcaattatcctgcctcggcctcctgagtagctgggattacaggcacctactaccacgcccagaaaattttttgtatttttagtagagacagggtttcactatgttggccaggctggtctcgaattcttgaccttgtgatccacccacctcgacttccaaagtgctggaattacaggcatgagccaccgcgcccagcagaggtttcttttaatattactactttggagtacaaattaaagctttaattatgtgaaagaccacattcctcaacaataactgataaatgtggcctgattaagatgtttatactaatataggctgtaagtttaaatattctttaaataatgtaaagagattttatttacctataattttatttcatatgtacatgttaaaagacagacctctttgggaggccgaggtgagcggatcacgaggtcaggagatcgagaccatcctggctaatacagtgaaaccctgtctctactaaaaatataaaaattagccgggcttggtggcgggcgcctgtagttccagctactcgggaggctgaggcaggagaatggggtgaacccaggagccgagatcgtgccactgcactccagcctgggtgacagagcaagactccgtctcaaaaaaaaaaaaaaaaaaaaaaaaaagacagacctactggtcagcttataaatgtaaatacatgtaaaaaagaggccatgtgtggcctgtaattccagccctttgggatgccgaggcaggtggatcacctgaggtcaggaattcaagaccagcctggccaacatgttgaaaccccgtctctagcaaaaatacaaaaatttagccaggcgtggtggcgggcatctgtaatcccagctacacgggagggtgaggcaggagaatcacttgaacccaggaggcagaggctgcagtgagccaagatcgtggcactgcactccagcctgggcaacaagcgtgaaagtccgtctcaaaaaaaaaaacaagaaaggaaaacctttcggagaaatctgaaagaacagttccatcatatacactgaattactaaaagagaatgatatgccccaatttttctataattaagacactgacttttgttgacaaaatacagtcacaaatcttgagttaaaagattatcctgattgtacgaaagtttaaaagcacataaagcaaagtaaatagattaaattaacttgttaaaaagtactcaaggctaacatgttattctaataaacagcatgtggtatattatttgaggacattttgcatgtcctcaaaaaggcaatctgtaacagacatccacaaactgtgctaaagcattaaagcttttttcaaagtatattcctaatgcagaaatctagaacaaatgggctgcaaaagaatatgtaaaataaaaagaattccaccagtaactatagtgcaataattataaaacctactgccaacagaaaaacaatgccgggatgaccactaacacttatttttaaaatgttaatctgtcttcacaacattgatatcactcctcaaaaattcatataattgggccttctttaaaaaccctaaagctactctgtatcttcccaataagccatccaatgacctttagagaacctctcaaccatcagtcatgtgttatactcctttacctcaagatcatattcacctggtgaatatgatctagacataagaatcctaattctcttgatataagtctttcacattgtttaaaaaaacaaagaactcaaaatatacataaaacccttataagcactcctactaagcagacagtattactcacatttgacaaatgtgaaaacagaaatctgtactgcataacaccataaccctagcagctgggagtaataaacctacactctttggttactcaactggaattaaaactaattcttttcggtatcctacattttaagaaatgtattaaggaggcaataaaaccttatcaaaagccaaaatacactgcatatttctaaatatcacactattctgcaatattttaaggcagaagccacagagattgaagctttaaaaaattgagaatccttaagaatgaaactaggggccaggcacagtggctcacccctgtaatcccagcactttggaaggccaaagatggtgggtcacttgaggtcagcagttcgagaccagcctggccaacatggtgaaatcctgtctctactcaaaatacaaaaattagctaggcgaggtggcaggcgcctgtaatcccagctactcggggggctgaggcgggagaatcacttgaactggggagacgagggttgcagtaagcgaagatcacgccactgcagcctgggtgacagagcaagactctatctcaaaaaaaaaaaaagaatgaaactaaagaatattggccacaattaagacacaacaaacaacattgtactacatgtactacaggtactacaaacaagtattttaatggctcaaagattttttttcaacttccaaaacaatctaaatgttgcaaaagcttctttctaatgctgacagactaagcatgtttttttcttgtgaatcagtaaaacacagacaaagaggagttgttggtaatggggttcaaaccaaagaacattctaatggaaaacagattactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgccataagctctgtttattccaagcaccacaattcctagttaaaggggaaaaaaagtacaagcacttgagtgagcaaggcattcagagaacagactctacatcacacatctagctagcttcgaacttaacaaatcaaagaaattcatgacatcacgttcccttcaatcgatctcttcttaagcaccaagataatttgcaacattttggtaaattttacatcactaactcaaactagagggaagactagacttattagtgaaaattttaagttaaaggatactatttaaaatgtggtttcatcatcttcaagtagataccaaagtaaccgctaataaaccttgtcacatgcaggtattatagcatctgctttttctaggaccagttgttaatatctccatttttttgttgttcatactacacagttttcagtaattctatcccaagcttctctcctgatttctgtctgatatacttaacctgagggcacttccatttagatgtccaagaagtacttccaactcaacctatacaaaacaaagttcattatctctcccacaaacccagctgtcactcctaactgccccactttttaatcaaagaccatcacctaaacccagcctcccattccttccagttaccaattttctaaaaacagtactatgcatagaatgcatcccctacttaaaatcctttcattatttatttcaaaatatccaacttcaaagatcctaatttgatattcaaagttctacacaacctctactaaccttcttgttcttggagtagacaaattttcacagtgtatcagaaataccttccactgagtcagggtgggtatgtttcttatttgcaactgagctaaactgaagacaacaaaatgtacacatgccttcgctgtgcaagaaactgtgcagacccattctttaaagtataaagatgaacttctgctcacaagagtaaatttgcaagaattccaaatgctctcagtacagagaaaagcataaaggactgctatctgacaggatctgtattaaacagctgaatgactttgggtaggtcccaatactactgacaacagctaccaccagtaggcctcaggcactgctccaggtgctttaagcgaattaactcatgtaatccccaccacaacccaagaggtgggcactacttttatcaatagttaacggataaagaaatggagacttggagaggtgaagtaacttccttcagctattaagtggtaatctaactctatacttgaataaaactgtgttacactgttcaagcttcagtttcctcaggaagaaaatcaagcagctaagactagatgtgtccattcattcaaacatactgagtacgtactatagtgatcagcagccatggaactagagtctaggagggaaatacaaacattaataatcatagaaatcattaataatcataaatatcattaataatccattcaaactgctttacaagctgtaagtggtgctacagtaacttgtaaccagaattgataatggtctggggcaaaaggagatggttagggaaagcttaccccagacagtgaaggttagaaggataagtaggagtcaaggtgagagtgaaggagaggggctgactgccaggcagaggaaacaggaaaagcataaactagtcatggtcccactgaatgtcctgtaacctacgagggggagaagagagtgaccaatgaaagtaaagaggtcagcacaagccagaaatatccttacagaccttctaaaaagtctggtcttcatcctaataaccattgaaggagtttacgtaggtataaacatatacacatgcacatataaaactggcgggggaatagtttctatacttggagatcataccagaagtagacaggggtgggagcttcaagacacaattcgagtccaatcaacagataacaggtttggctgagattggtggtggtaaaaataaaggaaagtgaaaggattcaagaactattcaaaaattttaaatgagttaatgatgcctagactgaggactgatttaactggaagaaagtgttaaggagtatttaccaggtttctggcttcaccaattggatgaaagatgacatttaatgagacaaaatcataaaactaccaaggtgagggtggaggggagtaaagctcatgagtttctgtttttaattaaagtgaatctgaagtgcctttcagacatccaagttgatacaacgtccaagggctaagaatgcaggctctaaggtgtgattgctggggatgaaatcccagtctgccgcttactagctattcggcaagttacttaacctctgtgatcctcagtttcttactctattaagaattcggcaagttacttaacctctctgatcctcagtttcttactctattaagatactaacagttccacactccatgggactgtattagaatcgaatgatatgatacatgtaaaatttacaacatgaggacccaattaacctcccttctagcatgaacacctctcatgcagtaagtattaaaagtttcaccataatttctgctagatatgataatgctgacattattactgaagggtaaagtgccatcaaaatgtttctaacacagttaattccagcaattttggtcccatatctgagacttgatgttttgagtacttccacttcaaaaagctagaaattagctctgcaatctgaaatgaattatctaatatgtaacaactgtaccatcaaatgtatctgtaggcttttggtattctaaaatggaataaaaccttagctttattcagcaaagtctaaaagtttttttttataactgtctcactttaattcacaattcaatcacttctcaagaactcaattatcatgcatcctcctcacataacctagaaagtttaccaaactcagaaaagcttaggcgttcacatgccaaccttaattttcctgacttttcacaaaacatacaaaaatcttcagtgaatctgtaacaaggtcacatcacagcatgaatcctgctctataaagctcacacaactgaaagatgaatgtaacaactttgctgagactttaaaaacaaaacaaaatacgttctgcttatacaaaatgaaaaaatacactcaaagtgaaagtcctccttccctagaaccagctcattcccttccccagaagaagccacagttatcacagttacatgtaatgtaaccttccagaaaatgttcaacgtatctacatacagaaatagagttgtatattaccatttggcttgttgttgctattttacataaatggatcatatgttctgttggagctattctacataaataggttcatacattttttctttttttttaagagacaaggtcttgttgtgtcacccagactggagtgcagtggctccatcatagctcactgcagcctcaaagtcctgggcagtctccatctcaaaagaaaaaaaaagaaaagaaaaggaaatttggttatagagctatgcctcctacaacaaattacaaatatggagcccagataacagatgagacctggtgtattctgcactacttacccccacccacctaaagtgctgcatgctgtttgaggctcctgtgactaggagagttatcctattccttagaggctgctgagagcaccaaattttggacccacctctaagagaaataaaggcacccaggaaactccttcacctgtagtacccttgacctcatgtttttctttgcactgcttattgctggttcaacagtaaagcaaagcaaagcctaggtaatgttagccaagcctgagtcgtcattcttgccaattctcaaaggaggcggggtcaactttaagaaaccatgatgtatgtcctatctcatcaggaaatcaaggctaaagaaaaaaaaaaaaagaaaccatgatacccaaaaaaattttcgtttattatcttttattatctgatattctctcttctgtccattcagatcctaacttaaagtctgtccagacattctgcacaaatattcctttaattgcattcaagtcataacgaccaaaaaaatagaatatggtgcatattagtagctgtacttgcaatccctttatatctaacatattgttggtacacttaacggaagtgaagtcccggcatgactaagcttacccaaaagatgatggcattcaggctctaatcactccagtgctagtctatgcttccagctgaatttcttactattctgcttatgccacacttgccttatgttacgtcccaaatacaccacacatgttcacatctccatgcctttgaccatgttcttgtctctgtctggaataataagtaaggaataaagtcattcatcacactcctgaagcactgctacgtgctagtggcaatttacattaacaatctcatctcatcttcataacaaacctataaagttggtattgtttttcctgttttacacgtgagataagtctgcccaagaaccctcacaaatggcaaaatccactgcctattaaagaatgccttggaacccctttcaaatggcgaaaccctgcaggtattacagccctttcctcttaccatgccttgaaagttcacacagcctactaataaccaggatctgcttcactacactaaaaccaatcacgacttacacgcttttcacttctgcttaacagattataggtgctcaacaaatgcatgtcaaaattaaaacactggtcctctggcttaacccggaggttaagggtggaaactgctattccacccttcacgacccttttagcttttccctgcactgccagtgaaaggaactgagctgtaacagtattccctaggattgtcagcctccttcaaagccttcaaagctctgtattgtattgctaatgatgtctcctcccgtagaaggtagctcaagggcaagatccataccatccacattcttatcgccagagctgaggaaaataaaaagtgctcaaaattgtttaaatgaagtggaacagtccctcaagactaactttctaagagaaaatgaacaagaggaaaaattgttccagctgagcagcttcaaatttaagattctccgtaataataaaaggcagtttcaccgcagcttttacaactccaccactaatagctgagtttacagaaagccattacacagcaacaataaagcctggtagcaaggattaaatccccagggtatatattgaccttggcttgtctggagcggagggcgtaagctgcacttctgtttgccgcgctgaatgcggtcactttacaggtaagctgctcgggggtacacgtttaggttattaaaagcaagaaataggtgcacaaggaagcggccacgctgggtgagtagggaggtgagaaaggggagggacccaggttcggtgcgcctgcctgacctcgaccccgcgtcctgccggcggacgctgcaccttatgcccgtcctgagagcgagcggccgcccgctgccccgcgcctgcccagcgttcgcacctcacctcggttctcctcctccaggtgccgcacccgcagctcgtcctccgtcttcatctcagagctgtagccccttttcggggcgggacccccggccgcaggtacccagccctgggcccagatcgccgggcccgctcgccggcctgccaacgagccgggcagcctcaaccccgggcagagccacgcactgcaagcggccaccaggcgggcgccgccagcatgcagggatcccaaggccccaggtgccgccgccaccgcggccgccatgttgtctgtttacggcgtggacctgcgacggccgctccgcccccgcccggcgccgacctgccgcgcgcacgcgcacggcgtccggacccgccgcctcgctccggcttggccccgccctccggagccgtgttcccgcccctcactgccccgccgaagcccggtgacccgaggccttgccccattctccaagcgagattggatggtttgtccaatacaaaaggaaagaaagtagttttccaaggttatggaataattcagggaagacttttctataagaaccacccggagggaattatctccccgtactccctggaccatgccctgcggtcctgtgttaagtaagctgcaaaagtgaacaaaaaagttttgtctcctcaagttggctgaaagtgtggcagcccatcgttggtcactgccttacttatggatctcaggttgttggtttagcgtccctgataagcataaatgatgtttactacgtggcgttcaggaaaaggatgagaacagcaaacaggcaaaggagttctttctccagcccacccactcgtaccgatgtcccatggcccttcctggacggaaagagtcttacaggggttcaaacaagccatacgctgagatgggatttagagtatgtagctcttccagaaactcgggatatcaatttagtgtgtaggtactcatcaaagcacgttgcagtataattaatgctacctagcttttatcagatctctaatgggaaagcttgcatttaagaatactgggcagggggcggtggctcacgcctgtaatccaagcactttgggaggccgaggcaggtggatcacctgaggtcaggagtttgagaccagccgggccaacgtggtgaaaccctgtctctactaaaaatacaaaattagccaggtgtggcggcacacgcctgtaatcccagctactcgggaggctgagacaggagaattgcttgaacccgggaggcggaggttgccctgagctgagactgcaccattgcactccagtccaggcaacaagagtgaaactctgtctcaaaaaaaaaaaaaaaaaaaaaaaagaatactgtttgaaaagtgtgctgctatgagcatacgtctagtgccacagaaatttcttgtattttttagtcctaagcaaaacatccttcattatgtcctcaacttttatccaatgtagaaacaaaaagtagactgaattccattactgcatctgctgtaaaatgatgttgaaggcacttttatttttatttttattttttattttttgacaggttctggctctgtcggccaggctggagtgcagtggtgtgatcgcctctcgctgcaacctctgcatctcaggctcaaatgatcctcccacctcagcctcctgagtagctgggatcacaggcacacaccaccacacctgggtaatttttgtatttttagtagagatgggtgtttctatgttggccaggctggtcttgaacacctgacatcaagtgatccacccaacttgacctcccagaatgctgggattacaggtgtgagccaccatgcacagcccactttttattctatcttttgtaaagttccatgcaggaaaattttcctgaagtttactacaaggaaaactttgcttcctttgtatctttcctcttttctgataatgatgtacatgttgactgctgggtgttgtgatttttattgttatggtttctttctaatttggtcttgtggtcaccagagggagggtaaatctggaggtgacagggagttcagccagtggaagggggtcaaggaaggggcacttgtggagctaaagcctctgttggggtccagcgtgttacccaagcagtttcccatggaagttctaattggtgagtttagaacaagcaggcacaagttccatggagtcaccctgtcactgtgaggtggtcactggagcccatctacacagtccatgtgggttatggaggtcaacaggtgagtcaagcaggctgcatttacctgtcccatagggagatggtcaccaggaagcagttgcattaagcagatatctggatggatcacattgaagaactgggaggaagcagagaactggaaactgtatcaaaggtgattgagccctgcttctcatatgagaaagttaaacatattcaaaatggataccaaggcaaaataaaattatgagaattactgtactagagatggcagcggctgctccagacggcctactgctgcagcagggaggcatggccagggctgcacgctctctggcgggagccagggacaagcgggagacccaccccttctgagttggggtgggaactccctggttgcctctgcagcacagctgcagactggggcctcctgctccacagagcaggcagaagcaccacccaaggtgtggctgcagatctgagcctccctgtgctcttagggggccaggagcaggcaggagccctgccctccccgagggcagctgtagccacccaaaccacggctgcagccccaggcatccctgcactcttgggggcccaggaaggccctgcatgccctcacaggctcagaaatgcctgctcctgctgcctggcttctccctgctgttggcacctgctccattcttggagcaaagttgaggctgaacccaggcaccatgaatggcagtgggaggcagacagactcctgggcagaagggggtgggtccccagtgaggccccagcttctggccaaggagggcctgaaggctgggggttgggctgccagccccatgaaccagagtgggaacttgtggtgccttttccgagcctgcccatggctgcccatggaccaatcagcggcaggcacttgctcccctctgaggcccataaaatccccaactcagccagagctgagcagatgatgggacaaccagctgcagagaggagctaccctctcagctgagagcttcagagacttgcagagatgtcagaactaccagcttcagagaggagtgaccctctccagggcctcctctctgctaggagctgggcagatgttaggacaaccagctgcagagaggagctaccctctccagggcctcctctctcctaggagctgggcagacttcaggacaccctgcctacagagaggagctacccactgcgggtctcctccgagctgttttaatgctcaataaagcttctctttgtcttgttcaccctccacttgtctgcatacctcattcttcctggacccaggacaagaactctggcaaaggtgccaccagccacagaggtttctggccaggaaatcgacacctcaaaggttccgtaacactaggaaactcacaattgtatttacagatcaaccattgcaattattgcaattatataattactgtttattaatattggtctccagttgttttgatatctttatgtcggttcatcaatagatggtaaatttagagaaagcagttatacagagctcctgacagtgctatttaaaataatataacttcagataatactgataattgactaggacagctgcagaaagataatcatagattgtttgggttatagaagaaaacaaaggaccacccattgtttctaaaggcatagagcctgatggaaaaaatgcaacatagaggactatccccttccctaacatttgggactctcgtccttatttgcaatagtcatgcacgtatctcaggtctgtgaccaaagttgattcttaaaaattaatgcaactaataaacatcaccatgactatcacaacctgtcaagcatgacaactaacagcaaattgccaaatatcaggaatttaacaaattccaaaccaaatagacatggctttggatccctgctctataattgctccactttgagacatcagtgagttatttaaatacttcatgcttcctcttcttcatctgcagtatagctaatatatctatttcactttatgaattctttttttttcttttttcagacagagtctcactctgtcacccaggctggagggcagtggcgtggtctcaccttctgggttcaagtgattctcctgcctcagcctcccgagtagctgggactatgggcaggcaccatcatgcccagctaattttgttttttctttttgtagaaacaaggttttgtcacgttggccaggcttatctcgaactcctgacgtcaggtgatccatctgcctcagcctcccaaagtgctgagattacagtcatgagccaccatgccccactgaattatcttcaattccttcacctataaaatgagaataattatgcccatttattgggttgataagtatgtaaaacacttggcaccaagaaagaaatagagcagcgtggaaatattagctaccatttaccaacttccttcttagtctatttaagaaggcatttcgctgtcttatttaatgttcaggaaactttcaagttggtattactacccccatttttatagatgaggaaactgagattaagttacttaccaaagactgcatctgggaagccatggagctggaattcaaatactgatacatctgactccaaagctcatgttctttttcttttttaaaaatcttttaatttttttttttttttactagaaacaagggtgtcactatgttacccaagctggttttgaacttaggctcaagccgtccttctgcctcagcctcccaaagcgctggattatatgtgtgagccagtgggcccagccaaagcccatattcttaatcactagttagaacagcctttcaataaatgttaaggtactcaataaaatgtcatgacctctggaatttctacttttcaatgaaagattgtcaagtatgaaacaggaataatgagtatcagtttgggaaaaggcgggtagggcttgttgtttgaaatgagaagagtatagccaggtgtggtggtgtgcattgggaggttgaagcaggaggattgcttgagcccaggagttcaaggtcaatctgggcaacatagcaagactctgccactgaaaaaaataataattaaaaaaaaaaggaagaaatggcaagagtgaaagagtggaaaagctggagtattcagagtactacacccactaatctcctgacctgcttctacttcttctacatccagcagaactgtgaggcaaacaaacctcctttctttagaaactacccagcctcaggtattcttttatagcaatgcaaaatggactaaggcaaggaccaaatatctttttcttagtatatcacgatatcataagccccatggtggcctttcactccagaaggtcttttcccatctagtctgagtacttacctccaaaaggagggattggatgtcaaatccagaaaatccaatctctagagccttgaagggatccagtaagccttacccaaggacactacccccagagaaaaggtatgtttgaagacaccctctctcactctgccctgcagagactccttgaccagacactgcaatccacccccaccaaggtattgtaggtctcattttaggtagcaaccatgtgtgcctatgagctccatgacctctggagaagagtagacattatacagacaagtaaagagaggcataaattactgaaagttacatagctaataaataacaaagctggaactggaactcaaacactccactccaaaaacctgagttcttaatcatgactttcttttgtttgcttttcctaattgattgtaagggcttcatcttctccaccactactctgaccccaatcagtagggagttttatcaagcccttctattatcatttcatttggaaatttcacccactgcgttggatcctgcatggtcacgatttcccagatactgcttcttccccctgacaattccatagttgctgattgtgtatacgtgcatacatgcaaatatgcaaacacatgtgccatgtcctgaaaatacaaaccttcgtcatctcaggatgagagggatggggagactaggggatgagatcaaaaaggtacatggcatcttttggggatgataaggatgtcctaagtttattgtatgatggttgcacaaactctgagaatataccaaaaaccatttaattgtatatgttaaatcgggggattgcttggcatgtgaataatacttcaataaagctgctgcaaaagtcaggagacaggatttgggatccttgaagagatgactgattgagtgtctgagacagagaaaaactaggtgagatcagaatatctccttgtgccagaaaacactgaagtgctccacaattgacagaaatgtgaaagaccacagctcggaagggtttctactggccttgcctgggacaattagaatgttgaagagaaccatgctagtaattgatagaaacatttagcattttttaaagatatcagtgaacaattaagtaaatggatggcagatggtagaagccagtttctccctgttggtatgggagactacagataagcaagggaaggaggccaggatgatttgtttgataagggtttagcactggaaacatcagtatgaactcatgtttagcttaatatagatatagatggatacacatagaaacatctacagataagtacatatgcacacatgagtatacacacactcctgctctgtcagctaagatgaactagaagcaataacacaccatcgacaatgagcacacctagtgtcagatcttggtttctaataccatcctccagtaaaaaagaattccccattgatccttggagaaatgggtgattctaggactggggcaggaaatatacaagatgagcctgaaggatgttgtggtgccagaaaataagaaagtgttcaaaataaccccaaaatgatgggcagatgtcaaagagatgcaggaaccaactgagagagttcccagtggccacagctggaacaagatgaacaatagaataaagtggcatagcatgatatccgaaagcataaaataaatatccatgtatacatactgatacagataaatgattgaatagttaaatgagaagagaccaaactcccaagcagaagaatttccaataattcatgtagatactctgccctacctgaggaaggtgtcaaagataaagccaacagtagttaaagtagtaaagacagatattaatcagtgatatactattgtaataacataatatgatattcttgtctgctttcagcaggtctaggatagaaattgttcataaaattttaagtctaagatcaggaggcccaccctattgcttttaaccctcttagttgtaagataggtggtatctccctcatacccctccaaataggtaaaaggaatacctgctctatcagggtataactagacatctatggtcttagccccctcttgtttatagtctttgggttcattgtgccttgtcgcttaagcgcttgtctagtggatgagaatgttattctctcctctaaatcaaccaaccttctatggagtaaagggtactgaagaggatatgtcagtcagttcgggctgccataacaaataccacacactgggcagtttaaacaatagacatttatttcctcaaagttctggaagctgtaagttcgagatcaaggtgtcagcaggactggttccttctgaggtctctctctttggctcgcagatggtgtctccttcctgtgttcttacacggcctttcctctgtgcgtgcacatccctggtatgtcttctccttataagaccatctttccaactctcttttcagtaaatggtgctggggaaactgtctaaccatatgtagaagaatgaaactggacccctatctatcaccatatacaagggaaataactcaagatgaaataaagacttaaatttaagacctcaaactgtaacaatcagagaagaaaacctaggaaatactcttgtgaacatccatctagacaaagaatttacggcttagtcctcaaaagcaattgcaagaaaagcaaaaattgataagtgggaccttattaaattacagagcttctgcacagcaaaagaaaccattaacagagtatacagacaccctacagaacaggagaaatatttacaaactatgcatccagcacaccctaatatccagaatctataaagaccttaaacaaatcaacaagaatgaaacaaataacctcatttaaaaatgggcaaagctgccaggcatggtggctcacacttataattccagcactttgggaggccgaggcaggcagaccacttgggctcaggagttggagaccagcctggacaacatggcaaaactccatctctactaaaaatataaaaattagccaggcgtggtgacacacatctgtagtcccagctactggggtggggagctgaagtaggaggattgtttgagcctgggagtcagaggttgcagtgagctgagatcgggccactgcattccagcctgactgagagtgagatcctgtctcaaaaaataaaaataaaaaataaacaatgggcaaaggacattaacagacacttctcaaaagaagacatacagtcagctaacatgaaaaaatgctcaatatcactaattatcaaataaatgcaaataaaaaccacaatgacagtggtccccaacttttttggatcagtgaccggtttcatggaagacaatttttccatggactgggccaggggtgggggcgggagggaatggggatgaaactgttccacctctgatcattgggcattagggttttatacataaggaacactcaacctagatcccttgtatgcacagttcacaatagagtttggctcctctgagaatctcatgccccccctgatgtgacaggaggcgggggcttgggtggtaatgctcactggcccacctctcacctcctgctgtatggcccggttcctaacaggccgtggaccagtaccagtccatggcctgggaggtggggacccctgcacaatgagataccatctcataccagtcagaatggctattattaaaaagtcaaaaaataacagatgttggcaaggctgcagacaaaagggaatgcttatacattgctggtgagaatgtaaattagttcagccatggtggaaagcagtttggagatttcgttgtttttgttttgttttgttttttcgctctgtcgcccaggctggagtggtgcagtggcgtgatctaggctcactgcaagctccgcctcctgggttcacgccattctcctgcctcagcctcccgagtagctgggactacaggcacccaccaccacgcccagcaaattttttgtattttttagtagagaggagatttcttaaagaactaaaaatagaactaccattcgacccagtaatgagattactgggtacatacccaaaggaaaataaatacttctaccaaaaatgcactcatgtgtttatcacagcactattcagaatagaaaaatatgacacatatacaccacggaatactatgcagccataaaaagaatgaaatcgtgtcctttgcagcatcatggatgcagctggaggccattatcctaagcaaactaactcagaaacagaaaaccaaatactgcatgccgccacttgtaagtgagagctaaatcttgggtacacacgaacataaagatggaaacagtggacactgaggactccaaaaggagagatggagggagggaggcaagggctgaaaaacttcctattggaagtaccatgttcactatctgggtgatgggatcaatagaagccaaaacctcaacatcatgcaatatactcttgtaacaaacctgcacatgtaccccctgaaactaaattttaaattttaattttaaataaaggacacctttcctgtcagatgagggccccacccttatgatctcaattaaccttaatcacatctttaaaggccctatatccaaatgcacttactgtggggtttatggcttccacatatgaattggaggggtacaactcagtctataacaaagggattcttcttcctcagtttcccgtagccggttctgtagacctatccccatatccctgagcctccccaaatctgtggcagcctccctggatgataatagtgtcaacagcccacacctcctcctgtgctcataagcactctgtctccccctgttaaggaaggcaatttgccaaaggtcacatagctagtaagctgcagaaccttatgcaaatccatgcaaggtattttgtcataacctcctgcctccctgttcatgttctcttttttctccaggacatccagttattctcattaaagtctttgtcatagttaggcacgaggcactgacagtagaggcactgatagaataatgcttccttttgctcaaagaataggcattagctaatctcctgatcattagtgctttcagcagcttcagaaaaaaagcaacagatgacagtgcagttggtttgtctctttgattcgtgactatccagaaattaatttacaaaaaaaaaaaaaagcagcaaaatagattctacttctcaagacttttccagtgttgttctttttgtactgctctatcagggtcataattgtttctttgagtaaagtagttttccatttgtatcacaaagagaaaaatcacttggacatttgggggactagccaccaagctttgcaaaggccaggtctgcagtatgttagacactaactctcccaggccaggcacggtggctcacgcctgtaatcctagcacgttgggaggccgagaacagtggatcttctgagctcaggagttcaacaccagcctgggcaacataatgagacctcatctcccaaaaaaaaaaaaaaaaaaaaaaaattagccagacatggtggcatgcacctgtagtcccagctactcaggagatagaggcaggacaatcatgtgagctagaaaggtccaggctgcactgagctctgatcgggtcactgaactccagccaggatgacagagggagaccctgtctcaaaaaaaaaaaaaaaaaaaaatgaaaccaactctcgcactatcaggaaatgttctctctcttttctttttttttttttttttttttttttttgagatagaatctcactctgttgcccgggctggagtgcaatggcaaaatctttgcctcccaggctcaagcaattcttttgcctcagcctccagagtagctgggatcacaggcacatgctatcatgcccagctaatttttgtatttttagtagagatggggtttcaccgtgttggccaggctggtcttcaactcctgacctcaagtgatctgccctcctcggcctcccaaagtgctgggattacaggcgtgagccaccgtgcctggccggtatacagttccttttaggagagaattttctctctgtagaatctctgaatacagggaaaccagacatgaatttgaattctcataagcctctgtggttcaaggattagagcaacttgactcttttctacatagcaaaaagataaaattcagcccgtcctaaaccaacaatctcggctcactgcaacctctgcctcctaggttcaagccattctcttgcctcagcctccccagtagctgggattacaggcatgcaccaccacgcccagctaatttttgtatttttagtagagacggggtttcagcatgtctaacaaaatgccatagactggtggcttataaacaacagaaatttatttctcaatgttctggagactggcaagtgcaacatctaggtgccagcagattggttgcctgttgagggcccactttgggtccatacatggctcctcccagctgtgtcctcacatgatagaaggggcagggcatctctctggagtctcctttatgtttttctttttttgttgtttttttgagacagggtctctctctgttgcccaggctggagtgcagtggcgtgatcttggctcactgcagcctcaacttcctgagctcaagcaatcttcctgcctaagcctcccagggagctgggactacagttatgcaccaccatgcccagctaattttggtattttggtagcaatggggtttcaccatgttacccaggctggtcttgaactcctgagctcaagtaatcggcccaccttggccttccaaagtgttgagattataggcatcagccgctacgtctgccctgagatcagttttataagggcactaatcccaattcgtgagggcttcactttcctgacctataacttcccaaaggccccatatccaaaaaccatcacagtagtgattacatttcaacataggaattttggggggacataagcattcagaccatagcaattcgtttgagggtttaatgaaataatatatgtaaagtacttagtatagtacagcatattatatgcattcaataaatatcagttgttatttttattacctttaagatacaataactttggcatgattagttattctgagacaatatacattaggatagggaaaaaaaaaaaccctaggacttctgcttgtatttttacttctccctataacttttgtgtgtgtacatacatacatatacatatgtgtgtatatatacatatatgtgtgaacgtgtatatataggaattatgtacctaaaaatgttttcactggtagaagatgtgatttttaaaaattggagacaattggctcagagatttaataaaagttcagaaacatgtatttgtatagcattttcttttttcttttttttttttttttgagacggagtcttgctctgtcacccaggctggagtgcagtggcgcgatctcggctcactgcaaactccgcctcccaggttcacaccattctcctgcctcagcctcccaagtagctgggactacaggcgcccgccaccatgcccagctaattttttgtatttttagtagagaccgggtttcactgtgttagccaagatggtctcgatctcctgacctcatgatccacccgccttggcctcccaaaatgctgggattacaggtgtgagccacagtgcctggccagtgtatagcattttcacctgatcttagccaaaaggccaagaactgttatagaattttcattctcaagattaagtctctttcatacaaaccacaacatattttcaaatcattgcttatttaaagcttgccaacctgtagcgtagcatgtgaatattcacattttgaactagggccaagaaagccaggatgatgcgtttctttccaaccccagcaattcattaaaattcctttgtcaaatcaacagatcaagagcagtgtattgcctaggatggtcggtttattttcaggaactgaatttataaataattcaggaaatgaatcagaccttattttatcagcaacattactatagatgtccagtagaaactctccatgtgtgtcatcttatatgaagtcacttgataattatctatctccaaattagaaaacctagttaaatgaagctggggcttgggagatgtggaaggaagaactcctgattttcaacccctgttaatcagcagcagtgcgggcgccctgtgcttcttgcacagttgtcctgtgccaccttcctgagtggctaccacccaggaagttgatgcagaggacctgccatgtgggagcctgactttcttttttttcgagatggagtttcactcttgttgcccaggctggggtgcaatgccgttatctcggctcactgcagcctctgcctcccaggttcaagcaattcttctgcctcagcctcccaagtagctaggattacaggcacgcgccaccatgcccagctaatattttgtatttttaatagagacggggtttcaccatgttggccaggctggtctcaaactcctgaccttcaagtgatccacccaccttggcctcccaaagtgctgggatcacagacttgagccactttgcccggccctgacttttatttttctaagaaaaaggtattctacagttgcatttcaagacaaaagggagactgtcaaaattttgcttgaaataataaccactttgaaagagaaacagaagagaaaggggagaaaaacctaagaatatcaaacctatcaaacaaattattttttgaaacaatagagaagtcccctccaagtattaggtgttttggggtgcagagccccagggagagggggcacagctcagaaatccctgtggcttgtttcaactcagtcacaatctgttgtaacccagcaaacgcccaggaatatgttggcctttagagccaaaaggcatatttagccctaaagacgacttgttttcctattaaatataaaagaaatagcatatatttttagcaagcacatcactgacgtgctactagcgaaaattatgcctaaatgggggcatttggtataatctgaatcttgcttgggaaaatgcttgttgctttttataattatttatcaatggtattggtttctgggaagtacatatgtgatctactgtaagggaaagtataatctagagccacgtgttaagttttgacatctggggctaagtgctcttctttttcaagtccgtaggccaggatggatttctcaattatgttgaagaatgtctgtggtttttatgtgtgttctcagaattcacacttcattactgctaaatgatcagaatcatgagaacagtggctttgtgcatcttacatgccattgtgtccccggggtctgccacaatgcctggcacaaattagatggtctaaaacactgcattttttaaatgtttattttaggtttagaggtacatgtgcaggtgcgttacataggtcatttgcatgtcacatgagttggctgtacagattatttcttttttttttttttttttttgagacagagtcttgctctgttgcccaggctgaagtgcagtggcacgatctctgctcactgcaacctctgcctcctgggttcaagtgattctcctgcctcagcctcctaagtagctgggattacaggcacctctcaccatgcctggctaattttttaaaatttttagtagagagggggtttcaccatgttggccaggctggttttgaactcctgacctcaagtgatccacccaccatggcctcccaaagtgctgagattacaggcgtgagctaccacgcctggctcagattatttcatcatccaagtaataagcacagtactcaataggtagtttttctatcctctctctccacccacaacaggcccaggtgcctgttgttcccttctttgtgtccatgtaaaacactgcatttgttcattctgttaaaataaaactaagatctgtggttttccatgaggtcagtcagaactaggaccaaaccctccaaaagttacgatttaattttgaagacttagcatttggcttttaaattagaattgtagagcaggtagtattaatccgtcactgttgtaccaattctggtagattagttaaaacatcatttctttagttgtatttttttaaacacgtcactcttcaatggattccatgagtcaaatgacaacacttaaagttaaaacattcctctgaatttcatttaaggcaaacgaaaacatggacagctggatgaagacctcagcctcactagggtagagcccaggtaggtattggccatattggtgctatggcacctttctacaggctctcacaaaatagggaatgaagaagtgacaaaataaaatgtgtgttcttagagtggccactcttgggtatacattggaatgtcctaggacggccaaactcttaaaattgctgataccaccctcagggattctgatttaattggtctaggctgcggcctggacattggtgtttttgtgttttttgtttgtttgtttgtttttcttagagatagggtttttctctgtcactcaggctggtggtaggatcatagctcactgcagcctcaaactcctagactcaagtgatcctcctgccctggcctataggcgcacaccaccatgccagctaatttttcttttaattttatggagatgggggtctcactatgttgtccaggttggttttaaactctgggcctcaggtgattctcccacctcggcctcccaaagtgctaggattacaagcatgagccacttcacctacctatacattggggtttttaaaagctccccagatgattccaatgtacagccaaggctgagaacgactgtgatatggtttggttttgtccccacccaaatctcatcttgaattgtaactccaacaattcccatgtgtcatgggagggacccattggaaggtaattgaatcatggggttgggtctttcctgtgctgttcttgtgatagtgaattagtctcacgagatctgatggttttaaaaaatgggagtttccctacaccagctctctctctctttgcctgcagccatccatgtaagatgtgacttgctcctccttgcctttcaccttccaccatgactgtgaggcctcctaagccatgtggaactgtgagtccaataagcctctttcttttgtaaattgcccagtcttgggtatgtcttatcggcagtgtgaaaacggactaatacacattgtattaaagtgttgttaggagaggcagattcttcaggccttttattttatatacagtacatataggcatttaaaagcaattgtaactaaattgcattcttctaagctatattctctttctgaagtacctaaaaattatttgaaattttacagctgaaaaatgctgtttgcccatcaatgcatatagacagtaagtgacttttgccttatgaacaaacttctggtcattttcatgttatggtgcccacagaaattgatatttgtacagcatacttaaggtcccttgaagggcagaaatgactaatccaatagttcctgcagctccaagcacacaaggtatcagtgtctcagcagaacaagaagaaaggctgcctgagaggctgtttccgacaactagggctcttttggccaagaaatgcataaaattgctgttctgggtaatcttctctgaattattgagcaagaacagcactctggaacttcatttatctgtagccaggataatgaaacacaagcaacattccaatgataacatttatcttgatttctatctccacacttaataaaaggaaccagatgtttctcttaaatcactatcaggctcttggtcatttcctggagttgataagagcccagcccatttcacagtagatactactgaggaaatacagaaaatgagaggagacagtagtgcattgactgcgtattagtttaaatattatgtaactctgtttatgaagttctcctccctactgcccaggggagaaagattacagcaaaaataattgagtattatttatttaagaacaggtgagatttctttttaaaatttaacccaaggtcagattatgagttcttatacaaagaaacaagaatgtagagtataattttaaaaattctatggtgtagcagttcttataggtaataatcttctgttttgttttataggaacacattatttggctgagaaattgagactttcttagcatcatttaatttatatttttagttttgcgaactattacagctgggccaagcacaaatgtatagtgtagtcaagttttgagtcccattcgagtttggaaatcccgactatagtaaaaaggagaagagggtgatagcagatagatgtgtatttttctcttgcttcctctcttgtctctaaaggagatttaaatggaattgagacagaagctatgaaatgcaggcttccaaaccagtgctggtattttgactatggtgttggcacactcccagagccctgggtgacattttaagtaaatgaagcagcctttttctctatatccttagaaaacttgtctcctgcctttctcctctctctgttcttaattcatcaggtcttgtcataatgttcaagaactctatggtcagaagagtgctatgcaattgtaaaatgagtgaagaatcttgctctagacagattgaattatatctgagatatacaattaagtgaaaaaaaagcaaagtaaacatatatatatatatatattttggttgagggaacagagtctcgctcggtcacccaggctggagtgcagtggtacacaatcttggctcactgcaacctccacctcccacccctaccccgcccctggttcaagtgattctcgtgcttcagtctcctgagtagctaggattacaggcatgtgccaccacgcccagctaatttttgtatttttagtagagacaagttttcaccatgttggccaggctggtctcaaactcctggcctcaagtgatctacccaccttggcttcccaaagtgctggaattacaggcacgggccactgtgccagaccaacatgagcatatatggtatgctactttttatgtaagaaagaagagaaagaaagaagacatacacatatctgcttatgtttacaagaacaaagaaaaatgcaaaaaggataagtcaaaaaaacgagaatagttacctataagtgaggggatgttgggatgaaagggatacagaagataatgacactattcctttttatatcagtttgatttttagaagcatgttaatgttctacatcttcaaaaaataatattaatttatgagaatgggaaagaagaaaaaaactgaaagcaaaccttaaactatctgtatttcaaatgaatatcgtaatcacactgaaagggaaaatgaggaacttatcccaataaattataaacgtagtccttggagagaatttccagggatcacgcaaagatggcagaagataatcctggaatatgctgttattcaaaaaagaaggaaatgctaaaaaaataaaataaaataaggggcacatgttgcatgagcaggctttaaggggatgccagtggccaaatcttagataatttgaacaccaaaataactaagatggtaataaattataaaccattaagaaaaaagggggaaatcaatgagtccatactgaagatagttgacaatagatagacagatacggatggatggatgggtgggtggatggatggttgattgcagtgcgaaagcatttgcttacagtagaatgtcaagggccaagtggtaaacatggaggaaatactggagttggaaattcatattacaacatccttcataaatactgattccatcaagaagcagtgatgaaggataaaccaagttggtgagccattatgataagcagcggatcctagtctttccccacagattgcttattgtaatgtaagagggaaaatactgtacaatggagaagctggacactagcatgactagatgatcaaaattagcaacaccaatgagtgatatcacttaccaccagatgtgaatcctgagaaagacccatcatctgcacagtatccaagtgacttgactctagtggtggggaggcattagacaaaccccaaatgaagaacattcttatacatatgtatattcttatattcttaaacgccacaaaagacaaagcctgaggaactatcccagatttcatttgttaaattatagcaactgacggaagttattgagacaactaaaattctttattacatttttgtgattaaatacttcaaacatggaaaatcacacaaagagtaacaaaatggcacctatattcccacaacccagtcctttcaaagtctagtattttgtcttagtttaaattattttaagggtattagatataatgggaacattaaagctatttctgaaatcctctcattgcctcttctttcccagagatgatcacttttctaaaatattgtgcttagtttcttgcaagttgttacactgttaactcttcaaactcagtatgtgtattttttaactcagtttgattttgaaatgtatcttttttgatacatgcagctctggctcactcttttgattatttgtattcaattaaaggactaaatcattattttattctctgttgatggcatttacattgctttcaaatttttttcagtattataggcaatactgcagtgaacattctgttatctgtcttcttatacacacttgccagaaaattacaaatattgtccaaatcatgaaactggtcaaaagatatgagcagttttagcttcataaaatattgagaaattatcctccaaagtagttgtgtgagcttatatttccattatcaatgcataagaatttctgtttcggccgggcgtggtggctcacacctgtaatcccagcactttgggaggctgaggtgggaggatcacgaggtcaggagatcgagaccatcctggctaacacagtgaaaccctgtctctactaaaaatacaaaaaaaaaaactggccgggcctagtggcggtcgcctatagtcccagctacttgggaggctgatgcaggagaatggtgtgaacccgggaggtagagcttgcagtgagtcgagatcacaccactgtactgcagcctggacaacagagcgagactccgtctggaaaaaaaaaaaaaaaggatttctgtttctacaaagataatgacaacaaattatttttcccatctgatggtcatgaaatggttgatctttgtgttttaaatttgctcttctcagattactagggagactgagtggttttacaaatgattatgcaatattttaatttcttctcctgtagattctttactcatatcctttaggtttttttctgagtggtatatcctgttttcattggtttgtagaagtttttaatacattctttatatcctcttatgtgcatttgagtatcttttctcactctttgagctctattttcattttatttctgttgtcgttggttgaatgggggttttactttaatgatgtcaggtttactggttgtttcttatcagatgtgccttttctatatattttaagatgtaagagtcttaaaacatattttcctatattttcttttaaaatattaaatattttatttttcacatttatgtgcttaatctatcaggaattatttctgtgtatggtgtgacacagtactctgattttaatttttcaatacatggatatccagttggcatagtctcaaaagtcaaatataccgataaacttgggtcgagcagtctacttcaatgaggtcatctctctctagatagaaagagtcctggaaatcctaatgttatcccttgggaaaagtctgttcctatctggtaccatcttttattagggctttctggggaggaggcacttctaaaaaactcaatttctgatttatagtttataaaaccacctgcaggagacaagactgaatagctgtgattagtcaatattatttaatcagaagagaggagaatggaatcccctatttgggtatttagccaatgatcatacagagagaaggaactatcagggaagatattgacaaatgtccagggtctttgattttgttcctatattagagttgtaccaaattacaaggagttttgtatccaggaataaactaatttgttgacagctttgcctcaatcattatacataacctaagtatgttctatccaacctgaaaagcaaatgattattgaaatttatattagttatattttatcactacgtaattaatttcttttttttgccgggtttaatctgtgtacctagattaggaaaaggaaaagaaaaaagaattgtcaaacatttaatcaatcaggatataaacatgggatagttttctgaaaacaggaaattattaaagccagaaaaataatatttaaattaggcatactactacctaaatttgactttttcagaattagagacttatttaaaatgactcaagaaatcagggcaaagctacaaaatagagaatgacctctcagaggttgactcttgtgagaagagttaacagtggggttctgttttcaagacagagaacaaaattgttttctctttttaaagagcagattgtatattcaagggtcaaaataatattcatctgaactattcactctctgtcttcattattcataagcttttttcatttaacatctttaatatactttatatgcatttttattaaatatacatatgtagttagttttaacttcagctttttaaaataaatattgataaattaaatatcattgtattatctaaagcaatatacatcatataaatttaccgtcttaatttgagctttgcaaagagcaaatatgctattatagagtggtctatcacttctataatctctgttcttatttatgcattttagttaccaaagatttcatgtgacaacattatttactaccttaattgaatattagtcataggtcttgaagacaatcacggatctcaaaaattatatttaaagtgtgatataatcattgttgattttaaaaatcgaaggtacaatatttaaaaatcacatgcagggctgggcatgttggctcacgcctgtaatcccagcactttgggaggctgaggcaggtggatcacccaaagtcaggaatttgagaccagcctggctaacatggcaaaaccctctctctactaaaaatacaaaaattagctaggggtggtggtgcatacctgtaatctcagctactcgggaggctggggtagaagaatcgcttaaacccaagagggcaaggttgcagtgagccaagatcgcactatggcactccagcctgggagacagagccagactccatctcaaaaaaaaaaaaaaaaattcacatggaagggctgggtgtggtggctcatgcctgtaatcccagcactttgggaggccgaggaaggtggatcgcttgagctcagaagttctagactgggccaaggcagcacagtgagaccctgtctctcaaaaaaaaaaaaaaaaaaaatcacatgcggatagcaagagtgaactgttttacactattatttcaggtttacaggaacaaatctttttagaaaacagcagttgctatttaatttagttaaatacatatatttatatttttatgcctttacatattttgtgtaaagagtgataatttatctgacccatgaaatcaacagaggaaatttagaaagtataaaataatgagatcagagagaagacaaatagatgtttttgaatatactgtgttttgaatatattgtgtgtactaacatactgtgttcaagtattcatattaaatgggaatataacacttgaagttcttttttcttttcagagttggggtctcactgtcacccaggctgaagtgagcaatcatgactcactgcagcctcaaactcctggtctccagtgatcctccaacttcagtctcctgagtaactgggactacaggcatgcaccaccatgcccagctagtttattcttttttttttttttttttgtagacacgggagctctctatgttgcccagactggtttcaaactcctggcctcaagcaatcctcccacctctgcttcccatcacaggcttgagccactgagcctggccacccatgatgttctccatacaatttgtatacctctgcatttaccaaccaaatgttacagttcatttaaattgtactgctgggcgtggtggctcatgcctgtaatcccagcactttagaaggccgaagagggcagatcatgaggtcaggagttcaagaccagcctggccaacacagtgaaacccccgtctctactgaaaacacaaaaattagccaggcctggtggcgtgcgcctgtagtctcagctactaaggaggctgaggcaggagaatcgcttcaacctgggaggcagaggttgcagtgagccgagattgcgccactgcactccagcctgggtgacagagcgagactccatctcaaaaaatatatataaaataaattgtacttaatagtactgacgttttctttcttttttttttttttttttttttggcgttttggtttatctagttatctagctgtttagtcattgttatttatggactctcttggccacttctgtaagacaaggacttatactgaaagactaacacccttaaaacattagaagtttggccgggcgcggtggctcacgcctgtaatcccagcactttgggaggcagaggcaggaggatcatgaggtcaggagatcgagaccatcctggctaacgcggtgaaaccccgcctctactaaaaatacaaaaaattagccgggcgtggtggcgggcgcctgtggtcccggctactcgggaggctgaggcaggagaatggcgtgaacccgggaggcggagcttgcagtgagccgaggtcgcgccactgcactccagcctgggcgacagagcgagactccgtctcaaaaaaaaaaaaaaaacaaaaaaaaaaaacattagaagtttattttgtcacccatcccaattttgttttgctttttgtttttgccctctgtcctattttaaattggtgcttcttaaagttctgtaggccaaattaataagaggaacttcatctaattccgaactcagagttcaaggggaggtaaaagaccaatttaaatggataagcctatgtacctctgcccctacctggaccacctgagttgtgaagtatgctggtcactttctctgatcattttctgcttgtgagcaggagtcatttttggagagatggcaggaccctgtagtagtggtcaggaattacggatctgcccggatagcaaatgccagtgctgagtttgtatcttaggtggtgagacagtatttctctgctccatgacaggggtctgggtaatacctgcccataacccatctgccatctttggctcagtttatttcctctgatctgtcaatctctccattgacaggtgaaaggctgacttcatcagcatgacatggatcacatttttgaagagctggtaaaatagcctcattgtttaaacgaatgtgtttttgttcaattcttgttgtcagagaatttgttcctgagtgtcctgcctgagtcttcagaaacacaatttactgtattctatgggataatttatgggggtttttggtggggttttttttttttttttcaaaagtgtcacttgccaagctttgtttttgtttgattagtgtacagtagtctcccttagccagggtttcactttccatggtttcagttacccacagtcaagtgccttccactaataggtgagtacagtacaataagatattttgagacacagactacattcacataacttttatttcagtatattcttataattgttcattttattatgagttattgttgttaatatcttactatgcttaatttatgttgattttttactgttccttgtgtaatacagtcttgtatatactttctgagttactttgtccattgactcctgttatatggcctcagatatttatttaaggtgagggttgggctacgtggcaatgttctttttgcttgtgtgtttgttttgttggttgggttttttgtttttttaatctttaaacattttttagagatagggtctcaccgtgttgcccaggctggagcacagtggccattcacaggcgcaatcacagtacactgcagccttgaatgcttgagctcaaacgacctcccacttcagtctactgagtaactgagactacaggcacgaagcatgcctggacttttctttctttttttttaatttttattattttttgctagattttgccacccttttgccatcagcttcccagtttgtagtctgtcaatgtgcagaccaggtagttaacaccatttggtattgttcaggaatcagtgtaaaatatgtcgccagttatgtctttgagcatagcttgtaattcagccaacttgacacatttctccacctttggctaagcctggccaggctcagtccctgggagtttcagcagagcatacccagggcctcaggcactgcctgtctgagagctttgaacagggagggcccaaatccgcagggccttcccctcaaggatcttcccaccccctaacccctccaagctttgttagaccccagcaggcccacagcaaatggcacaccacaggttctcagccccttctgtgatgtcattcttcattttacctgagtagagaggctgttatccccactgtgtctggctgggggtaaatccaacccattgcccttgtagtgttcagtgttgctggctagtttccagtttgttgtaatgcccagtatactattgtagcatgtgtgtggtgtggggtgtgtgtgtgtatgtttgtgtatctgtgtaaatcaatgtatcaatgtatttgattcagactgtccaaccacctacttgttgatgtcagaggcaagaaagcacagttatccaaaatagtgatttccaggtaaagggatggggagaataggagggaggtgagaccagcttgctcaggtgggtcaagggtgagctgttgtgagagtcttctcccaatgtcccaggtcttccagtaattgcataaagaggttacccgaggttaaaatatatgtctccagtacttaaatgtctctctgggcctctgtgtagttgttgtttttttttttttttttttttttggccagagaggaagagctgttatttttatttttcctttataacatctagtactaaaggccttctttgggtaatgcctaaatagtttattgctattttggcctaattgattcttttcctcagctacattctattatttttctttcaggtatttaacaagtgacatgttttgttttttcttttatgatgagttaatcttcaaagtttcttataaagagacagagaaaaaaataaggaggaaccactaggcacctattagaacgagtaccataaaaaatactgggtgctgggaaggataggaagcagccggaagcctcacgtgttgccaggggaatgcaaaacggtgccatcactttgaaaacggtttgacggtttctcagagttaagcacacacttacatatgacccagcaaccccacacctgggttttgaccctagagaaatgaaaagttcttttcttttaagatggagtttcactcttgttgcccaggcttgagttcagtggcacaatctcggctcaccaaaacctccgcctcccagattcaagtgattctcctgcctcggcctctcaagtagctgggattacaggtgtgtgccaccatgcccagctacttttgcatttttagtagagacggggtttcactatgttggtcaggctggtctcgaactcctgacctcaagtgatccactagcctcggcctcccaaagtgctgggattacgggcataagccattgcatctgggctgaaaagttcttttcacacaaaactttgcacaagctttacttgtaatagccctaaactggaaacaacccaaatgtctttcaaagagtgaatggctaacatatggtggtccagccgtagcatcatggtattctactctgcaataaaaaggagccaaccgttgatacacaaaacagcttggatcatctcaaaggtactgtgctaagtgaaggaagcctgactcaaaatgttaaatgccatgtgattccatttataagacattcttgaaaagacaaagacaaaaactataatgatagagtggttctgaacagaatttttctttggagtaacgatctcactctgtcacccaggctggagtgtagtcgtgtgatcacagcacactgtaaccttgaactcctcaagctatcctgccaccttagcctacaaagtaactgggacccataggtgcatgccaccacactgggttattttattttttttaaatatttttgtggagacatgctttgttgatcaggctgctctcaaactcctggcttcaagcgacccttctgccttggcctcccaaagtgctgggattataagtgtgaccaccatgcctggcccagaatttttttaatccattctgcgaattcattgtgtttcttgagacttagttactttcttctgtcatttgtttttatttatttttgagacagagtctcactctgtcatcactcaggctggagtgcagtagtgcaatcttggctcactgcaacctccacctccctggttcaagcaattctcatgccttggccacccaagtagctgggattacagatgcgcaccactatgcccagctcatttttgtgtttttagtaaagacgagttttcaccttgttggccaggctggtctcaaactccgggcctcaagtgatctgcccaccttggcctcccaaagtgctgagattacaggtgtgagccaccaccactcccggtgtggttttttttttttgtaacactctcactctgttgctcaggctggagtgcagtggtgcgattacagcacactgtaatctcgaactcctcaagcaattctcccaccttagcctaccaagtaactgggaccataggtgcacaccaccacactgggttattttatctttattttttatttttgttgagacgtgctttgttgtccaggctggtctccaactcctggcttcaagtgactcttctgccttggcctcccaaagtgctgggattacaaatgtgaccaccacacccagcccagaatttttttaattcattatgtttcttgagatttaaattcttctatcattatttatttatttatttatttttgagacagagtctcactctgtcatcacccaggctgaaatgcaatggcgcaatcttggctctctgcaacctctgcctccccagttcaagcaattcttgagcctcagccacccaagtagctgagattacaggtgcgtatagccatgcccagctgatttttgtatttttagtagagacggggtttcaccatgttggccaggctggtcttgaactcctggcctcaagagatccatccgccttggccttccaaagtgttagggttacagacgtgagccactgagccctgctttttttttttttttttttttttttttgagtaagactctcactctgtcactcaggttggagtgcagtggtgtgattacagcacactgtaacctcaaactcaagcgattcttccaccttagcctaccaagtaactgggaacataagtgcacgccaccacattgggttattttatctttattttttatttttgtagagacatgctttgttgcccaggctggtttcaaacccctggcttcaagtgactcttccaccttggcctcccaaagtgctgggattttttaaatccagcctagaattttttttaattcagtctgctaattcattatgtttcttgagatttaattaaattctcctatcatttgttttaagtctgacctagtataagccccccatttccttgatttgagcaacaggaccacaagaattacttcctggttttgaagcatacgatcgctctgttggttgatcatagtgatcctctttgtatcctccaggcagaggtgggggtgctgtcaaagactccccagggtcagctcccagaggtgggcagttgctactatagtctgatttctgccataacgtctgcctatgcacattatcaaagcccccactaacactgaagccattgcctttggctctaggtttttgcttcttgttttcactcctatggatttggttaggcctgcgttgagttttaacctggatttatttcctaaattcttgtttaatgccttttctacactagactgtgagtcagtttttcatagtcttcctaggctggaggttttcctttaagtatggctttgatttcagagagtctttctgcagtgtgacctcgttttcctgttaatttagttgggattcatcccatactcatcaccaacttgacattaccagccaagtagttgcagaggtcacagaacagaaagtctcaccggacaagttaaactcttccaggcacttaatgtattaagtcaatttaaaacacacacggagatgcaagggaaaagaaatacggttagttagcagacttagtgtagggtgtgagcaggatgaagggccaggctctctgaatcctggtacatgacagtgttcatgtggtgtgtctgtcatttgtctctgtctcatcagctgtccctatagatgatgttataaggactagtgttgaggtttgagccagggtgcccaaccataggaggtgcctggcaccaaggcggcaaggatgcctggccacttgacagcttgtcaattagcctgctgagcagataagggttttatttgcttttcttagacagagaacaggtagggccagaaagggtgtcactgatgggtggttgaattcaaacctcatgaatatgtattgcctcaagtgcctcctgtatatttagagtaatatatgttgggtatctctcagtccattctctcacgctttgcttgctaacaacttttctttatctaacgtatcttgagaattttgtggatgtcttccaagctacatacttactactcatctatacttctatcttaagtttcttcctttccatttttttccttccatagcagaattgaatattaacaaacaccaccaaaacatgcacgtaatgctatgcattttatactctactaccccaacctgttgagcaacgggactagggagggagacaaagccaacattcatttatgtgttatctcaggttctcttctattacttttattactaacaccactattagcaaacatggctttccatctgcaggccaaatgagcctgccaataccaggttctagaataagatctacttgcttgatcactggtagaactggacaactgctgtagctgataaactgtttgcttcctcatctttgtggggagctggtgccctaagactcaaggcacagaggagcagagaatgcatgcttccccagataggtagaccccagagggagatggaaaggaaaggggctaggccacaaggcctagaaaaggaaacaaaaaaatagttgcaagcatttgatcacatcggaatatgaacatatgtgataattttctgaagacaagaaattattaaagccagaaaaacaacatttaaattaagcatagtagtaagtaaatttagcttcttaaaaatgagagacttgtgcttcaagtgactcaagaaatcagtatactcatgcctgtaattgcagcactttgctgcaggccgaggcgagtggatcacctgagatcaggagttcaagaccagcctagccaacatggtgaaacccgtctctgctaaaaatacaaaaattagctgggtgtggtggtgggctcctgtaatccaagctactcaggaggctgaggtaggagaatcacttgaacccgggaggcagaggttgcagtgagctgagattgcgccactgcactccagcctagcaacagaataaggctccttctcaaaaaaaaaaaaaagaaaataaatcagtataaagctacaaacagaggacagcatcttagaggttgactcttgtgagttaagagttcactgtgcggttgtatagatttatacacacacacacacacacacacacacacacacacaagacagaggaattgatttagcataggaattggctcacgtaattatggaggcccaaggagtcccacaatttgttgtctgcaagctggagactcgggaaagccagtgatgtaaatcagtttgagtttgaaggcctgagaatcaggaacagtgaagtgacggtgtcagtctcggagtccaaatgccggagaacccagagtgctgatgtctgaggccaggagaagatggatgtcctagctcaaatggaagagatcaaattcgcccctcctctgcccttttgctctgtgtgggcccttaacaaattggatgatgcccactcacactgggaagagctaccctctttactcagtctaccaattcaaatggtaatcttttccagaaacactcttacaaatacacccggaaataatgctttaccagcatctgggtgtcctttaagtccagtcaagtcgatacctaaaattaaccatcatggcggccaaccgactaagtctgcatgaggaggtagtagagccctggggctcaccggcaagtaagaggcacattgcttgcctcctccaccgccatcgaaatgtgttgattatatgtaactttgagctgttaaatgtaattccactgcaattacatcatgaaactgagacagtatgatgggttactgacaaaagtaaaatgggtgtgaaaatgcctccatatggagactccatatgtgcatatgttttttgtgtaggtttgcatatataagcacttttaatatggaaaaatacacattaaaccacttcacattggtcatcttggggggatcagattggggaaggggaagttttaaatttttctttctatacttctatattatatttcttttatatttttataacgttaaaaatatcgtaaaaacctccttctccacttgagtcatgttcgaatgaaatcccacttaccaagtctgaaccgtcttggcgcaccattattaactgaatggtgctttgcatttctgaatggcctactgttggaaaaaaaatcgggaaccctaacaaccggctggatttgaggaatggatagagcaggtaggaggtaccttacctttattaaaatgccacaaacacttattgtgtaaagttaaataagtcactattaagagctgaattgtcttcctcaaaatttgtaagtggaagtcctaacacctggtacttcagaatgcgactatatttggagacagggtctttaaagaggcaattgagttaaaatgaggtcagtagggtgggccttcacccaatctgacaggtgtctttataaaaagagagagttagaggacacagacacacacagaagaccatgtgaagatgcagggagaagacgtcatctatctgcaagccaaggagagaggcttcagaaggagccaaccctgccaacaccttatcttaaacttctagcctccagaactacaagaaaatagattttttgttgtttaagcctccagactgtgggactttgttacagcagctctagaaaaccaaaagagccacaaatactcatatatagtatgtcttcattctaatggtacattaaaaaaaagattactgcctcatattgatgtttaaccatgtgtttgatgttcctgctttttaacttttaaagattcttttataattccttgcattttaccctcagaataatccaatgcattcagagaaatcaggtattcttattttacaagtgaagaaactgaggcacagaaggattaagtgacttgaccaaagtcttctagcaagtggtctcctgaaccgacagcctttctatgtaccacattcaacctatcaaatggagtatttcacaataactgtctctgctggtgcttatttccacataggtcacattcattcagcaaacatattgagcaactagtttgtgtctgtctttcttaggagttgaggagacaatgacggagaggacacagtcctgcttttgaggagcacatggtctaggtgtgttgacagacacatgaacaacattttatataatgtgagaaacactataatcacagcatgagtacggcattgtagggacaccactgagaatgtctttacagatgtggtagaaactgagtgggtcttgaagaattcaaaggagtttgtcagacagggatggggattcccaatggaagaagcttcatgtgcagaggcccagagttgtgcaaggtgggaacaaggacgctgaggatggaaaagagattggagtgtggcagtgcagggagggggagatttcatacttgtctactaaaaacgttagatacctttagctttatgacaaactcactgttttgtggttcttcatttttcactagtttcaccaagacagacttttttgggggccgttcctatagatcttacttctcacattttaatgagtatgatgtatcacctggggattttgttagagtgcagattctgattctgagaggggcctgctagtctgcatttctagaagattccatgtcagattctcgctgctggagcctggaccacactttgaatagcaaagcttagtctgtaaagtaagaaatcagaagattgggttgaccacatttgtattttaggaagttaaaccagacaaacatgtgtaaaactggttgtaagcgacttgctgctgcaagtcacaaaacaaaagttctgcggatatgtatcctgtgggttatgactcatttcaggaattcctcaaatggcaagaatacctcaaagattcatgaaatatgcattatttgaatgtactatgtatgtttcttcctaatttaatactttagtcctagtatagaagtggaattttagtagaattcttataagtaagtagtatgtttcaattacaggatatctacagcaaaaaataaaatgacttaaaaataatacaaataaaaccagcagtagttgacttggtgccatcttttctcaggaacgtgagtaatgactgggtcccatacatggagaacagattgctccacgcaaggcctattagaagttaacaccaaagcagatgttcttgaagctactgttaccattatagatgcaaatccagacaagctgttcccattttataggaaaaaaaatgtaataataaattaccatacttaccttaatggcttaataagaattcattagtgagcattcataaaagaggataagaagtttaaaaatgtactgcttaaaataattaatacttttatcacatcagaagcctaagacatagtaagcaatagcagatggtaattttaatatcttacaaatatcatgaaggctgctggaacccaaggtagaaaactgcaaaatacaatgactttggggtcagttgtaattataaagaagctcaaaggtcagagaccagatggaatccctctcaagtttaatccagagatgtttctcacaaagaatttaataggtgattgctttccctcaaagcctatttgaatgctagccctgaaagaatttacaaattttaaagggggaacttggccgggcacggtagctcacacctgtaatcccagcactttgggaggcctaggagagtgggtcgcctgaggtcaggagttcgggaccagcctggtcaacatagtgaaaccccgtctctactaaaaatacaaaaaaaaaaaaaattagcctggtgtagtggcacatgcttgtaatcccagctactcaggatgctgaggcaggagaattcgcttgaacctgagaggcggcggttgcagtgagccaagatcacaccattgcactccagtctgggcaacacaagcgaaactccgtctcaaaaaattataaaataaaataaaatacagggggatcttatattctttggccttatattctataaggagctttctggtgccttgaatcaacacaattcctgatggattcaaagccaaactttatgtagtttcccattgcctcattaaactgctcagtggtagaagctttttcctgtccactggaagaacactaaggcaggctatgactttccttgttcatttttaggtaataaacaagtcttaggcatgttataagacaaacatagcctcaattttaaaatatagtgcaggtgtcaaaaatagttcaaaactggaaaccatctataaggctatcttagccattaaaatccaagctggtgagaagaaatagggagaagaagaaatagagatgtgtgtatatttttaacatttggaaacatctaaaagctttaaactgggatgtcaaaatgtgccttacctttttttttttttgtaaaaacccaattagctgatcaagtatatgaaaagctgccattcctctacctccaatccctcctcatacaaagcagtggtctttactggggtccaaggatgatgcccagtatgtttacaaaattatcctttgtgatgcagggagaatattggaattatttttcatatttatttgtctgaaaatgagatacattaagctttaataatatttattttatttattcctgtttttgagacagttctcgctctgtcacccaggctggagtgcagcggctcactgcaacctccgcctcctgggttcaagcaattctcgtgcttcagccacctaagtagctgggattataggtgtgtaccaccacacccagctaatttttgtatttttagtagagatagggtttcaaacttctggcctcaagtgatctgcccaccttggcctcccaaagtgctaggattataggcatgagccaccccactcagcaaggtttattaatatttaatattctaactgactttagtacctgcactttctcatcgaatagaaggatgggtggatggatggataaaaagataggtagatagatagatagatgtatgatgtatgtatgggtagataagtaaatagataacagctagatggatgagttaatgggtggatagacagatgatagatggatgatagatggttgatagatagggaggaaagtagataatagatacatagatagatgtacttttttcttttcttttcttttcttccttttttcttttttttttttaatagctaggactgtgggataaacaaaagttggaaaccactggtctaaaatactaggacatttttgttttgcatttccagaatctggcaaggtactacttaatttattcaagttgttttcaaggggtaccatttaagagggctgatttttagatggaaagaacagtaatgccagtagtacacagatattatctaacctagaaaatgattgtcttgaaaaggtagtcctaattttcttgtatcagaatttactttgaataatgctacaggaaaagagctgtatgatggatgccagggcaggcgcgtgctgtagacgtggaagcagaagagcacccaggatatggggtgatgaagaatgttgtcacagagtagggaagagcagaactcttttaccaggtagaagcccaataccacacacacacacacacacacacacacacacacacacgaaaaagaggagcactaatgagaggagaactgggccttgagacctaggctttcatgcccccttcttttgcctcccagaggccagtaaagcctctctgtgggcttcctgggttccagggagaacagttcacatcagtggtatgaaatcacggctttcaagactttgcttcagcagagacctatcataagagatgcattttacattggaaatgcaaacatgtcaggatgtgtgtttcttgaaactgcagcttgacttgctaccttgaatgcactgccatgtcatctgttcctgcatctgaaatgctggctagtgtccctggcattcatggcacaagccagtgcagttgcaacccacagtctggaattcacagagaatgggagatacgctaggaaaggttagtatcagctgaaatgttaagggtcttaagtttcagacaaggaggtttaggcgttgttatttgtaaccaagagggtctcctgaggtttttagaaggggggcaatgtggccagacacagtggctcatgcctataatcccagcattttggaaagccaaggcggaaggattgcttgagcccgggagttctagaccagtcagagcaacatcatgaaaccctgtctctattaaaaaaaaatttaaaaattatggtggcgcgaactttaaatgtaaaatttaaaaacttcaaatttagcattaaaaaaaaaatggtgccacgaacctgtaatcccagctacttggaaggctgaggcgggatgactgcttgagccatgcaagcaatcatcaaggtcaaggctgcagtgagccatgattgcaccactgtattccagcctgggcgacagagtgagatcctgttccccccaaaaaagaaggtgggcagtgtgtctcaatgtgggctttggggaggtggtcggcctgtagcagtaggcacagtgtggtagatggtgcagggctcactggcactggggacagtagtgatagcccacagactagtttaggctcttgcagcctaaactgggggagtaaaatagttattatgcttctcaccctctcccccatgatttttttgcccttaaaaatgctaccagctcagacctaaggaagtgtcgcatagcgattaggagtgtggctctcaaagtcacctccttgctcctcacctacccactctgtgcacgtggccaggtgacttaaatttccctgccgacctctgcgaaaggctatttctgggacacaggaagagctctcaaagtacagtgaatgttagtggcattgtgcagaagcccaatgttagtggcatcgcgcagaagcccagaggaccacacttcctcgggagttggcgctcacggagtccagctgtgccagccatgtccccagggaaacaattcccctctgcaaaggcagaacattcctctgaagcagcttccaaatctgctgtcacttgcggcctggtcacctagttcttcaatcacaattgtgggaagagggggcaaaggaaatgccagcagggctcttgccttagcactcactgtgactgtgtatgtttaaaatacataaaaggcatactcaaaaatgacctgttgttcattctttcttacgctttcatcataaatatgcgttactgcacgtttaaggcaccatttaatttttggtacgctattcataatactgaggtgtaagagaacttgcaagaacattaggcagggacaaataaaagtagcaggctctagccatcgcttgtattttcttctgcttagccatttttgattgctttctccagttatttatttattacccaatatgaagcacagagaggaaaaaagatgttttgtttttgttttttaagagacaaggtctcgccatcacccaggctggagtgcaatggagctatcatagctcactgcagtctcaaactcctgggctcaagcaatctttccacctcaccctcccaagtagctgggactgcaggtgcccaccaccacctcagctaatttttaaaaattttttatagagacggggtcttgctgtgttgcccaggctggtcttaaactcctgcctaaaggggtccttctgccttgtcctttcaaagtgctgggattacaggtgagagccaccccacgttggtgctttcaccagttattacagcatacgtttatttctttcttttttcttttttttgagacaagggtctcgctctgttgcccaggctggagtgtagtggcatgatctcagctcactgcaacctccacctcccgggttcaagtgattctcttgcctcagccttttgagtagctgggactacaggtgtgcaccaccacacctgtattctttgtatttttaatagagacaggatttcaccatgttggccaggctggtcttgaactcgtgccctcaggtgatccgcctgcctcagcctcccaaagtgctggaatttcaggtgtgagccaccatgcttggcctatagtacactttgctctatcctagaactttctggcctgaggctaatttactctcaaacttaatgaatgggaagagtgacacttccctcatttctgccttattccatgactctgaggaggtgctaagatgcttccttctacctggaaaaagtgagtttttaagtgtgttttgcaagctttaggcctaatttgcatgttcacagcaagtgaagtggaaaatatagacaattatcttgatttttctagaaacacactcatttaaaatatcaaaaaattcagaatattttcccttgaattatttcagtaattatcccaattttgttctgtattgatgttggtatgatattaggtgccacttggggcatacaatacaaaagcaactacaaactgaagaagcaaaaaataacatcatgatacttatcatactttgcggaaaatgaagaacaggttcattacaatgcaccatcttcagtgaccctggctctgctggggtttcactgttgttgaagtgttcagaacacactaatgtacccagggaaggaagagctctttggcttctccagatctttttcttgactcctgctcacctgctctcctgactctcccacctggattcaccttgagctgacacccctgataagtctttcagcagcatttacaaggttacatttcctccagccattcctaagtgaatcaaaggcattttcttaagcctggaattcaaggtcctttggcaactggttctatgttcatctttgaattctgttactaatcctctgaataaattcccttctgcaatgatgcagagtacttcatcactttaccgccccctgcccccaacagtagtattcatgcccaacacgtcttccctgctcatccaagttctaaattttccttctcatctaggttctttcttttttgctttctttttatgtctttttttttttttcctgagacagggtcttgctgtgtcacccaggctggagtgcagtggtacaataacggctcactgcagccttgacctcctgggctcaagtgattgtcctacttcagcttcttgaccagctgggactacaggcacacaccaccacactcggctaatttttaaattttttgcagagatggggtttccccatgttgcccaggctggtctcgaactcctgagctcaagcaatcctccttcctggcctcccaaagtgatgggattacaggtgtgactaccacacctgactaatccaggttctttaattgccaaaatgtcctttagtttcttcccagttctgtttcctgagtttctttggtagatatatttcttttttttttttttgagatggagtctcgccttgtcgccctcgctggaatgcagtggcacaatcttggctcactgcaacctccgcctcttgggttcaagtaattctctgcctcagcctcccgagtagctgggatcacaagcatgcgccaccatgcccagctaatttttgtacttttagtagagacagggtttcaccatcttggccaggctggtcttgaactcctgaccttgtgatctgcccgccttggcctcccaaagtgctagaattataggcgtgagccactgcacccagccagatagatttctttctacctattctacctcttgataatgtactctattggctcttactacttttagcattttggtctttcctttacaggtagatttaaaactcttcacaaggagatagtttctttttgttatgtttcctttacagcatgttgcacagaactgggtatccattaggcgattcatggtcattgaaaattagcaggtaggggtgttccctaacccctgagatctagataagatgacctccaggtcttagttgcatgggtcgtcacagtccaagtctccttccagattctgcaggttcctcgggtcagccttcatggccatggccttggactcctgctttcagacaagctgctctgcagaatgctcactcagatataaagtccagcaaacaaaaactcacaaaaagcatttctgagtctagtaggacctactgaaaatctaaggaggaaatattctggactgtttccattcggcaatggaaactatttcaaatcagacagtggccttctgggtcctgtggctgcccacccacagggagtctgcattggctctttagccaggcagggttccctcccttctcttttctcctccatcctctttctttcaaaagcaatcctccccgctgccctaaaaaagcacaaatcaccaccatcatctgactcactttctctgcaaagcaacttacctatgtttgtgccaggcatctacaaacatcacggtttttagcatttctgctgggatcccagtatcatatcaaagttcttttctcagaaagaaagttccctctctcactagaaatctgacatagctgttagaacaactttgttttttaaccctgttatactgaaatatgtttacttcaggggttattaattttgaggttccttcctgttcttcatctcccttttgttagattgctatgttattcttgaacaacttcctttttctccctcctttcctaccatgatttcttccatgtactctttcaaaagtttcttgacctccagaactttggactttattaaggttttttccccaaagtaaccttttccttctcaagtggatcagattgacaaaagtgaggtataaaaaatggccgtcatacctgtctgggctacttagctgaaatagtttactttagaaggctctacacaagtacttctgtttgcctctctgtagacttatcgatactcagcagacagtaaccactctttgccggtctccagcatgacttagcagtgacagcttctctctcccaactttctaagtagcgcctcttcgtcaggaagtgtcgtctattttctggtgctcatactaccccgggtcttattttcactaattcttgaattaattttttccttacatccactagaatcaaaataagcaacctctgggaattactgccaaactctctctctcttttttttccctcgagatggagtcttgccctgtcactcaggctggagttcagtggcatgatctcagttcactgcaacctccgcctcccgggttcaagcaattctcttgtctcagcctcccaagtagctgggattacagatgcgcgcaccacgcccggccaatttttatatttttagtacagacaggctttcaccatgttggccaggctgatcttgaactactgacctcaggtgatccgcctgcctcagcctcccaaagtgctgggattacaggtgtgagccaccgtgcatggctgactctttaaaccagttgtattttttattacctttccagagatatccttgtgtacctttttctgggaagactatatggttcataattctgcatgttctcttacttctgtatcctcactggtattttgagtatgccacaatttcacatccttggcaagattttttttttcttttttttctttttttttgagatggagtctcgctcttgtcacccaggctggagtgcagtggcacaatctcagctcactgcaacctctgtcttctgggttcaagtgattctactctctcagcctcctgagtagctgggaatacgggtgcccgccaccacacctggctaatttttgtatttttagtagagacagggtttcaccatgttggccaggctggtctcgaacccttgacctgaggtgatccgcccgccttgtcatcccaaagtgctgggattacaggcgtgagccaccacacccaaccacaagtttttcttatttaaatttttttggtgcaagtagctggtggcccagcacaagacatcccagtggtaattaatactacacttcaacaactccccatctctgccccacagaacacaaagcaacaaaaaccaggtgggtgctgccaataattttcatttctgagaaataattcatagttttcaaaaaatgagcttaacagctactagttttttaaaaaatgtaacatgatttcttttaaggttttaattaacaacggctgtgtgtcaaaaaggtgcccatttgtgaggaatctgacttcaggagaggaaacacgtgtgcatatccatgagcaatggaagacctacgctgatgggggctgttttaatttgggaatgtttgctggttgaggacaaaaaagaataaagttattacacagttattatatatctatacaagtagatgcttagacagcagttttactgattgacagagcaaagtcactttggatactcccttggactccttccttttctcatgcaggttggagagacgccttagtctcatttcccgggtatatcgggggaagaacaaagtgcctgacctgaccgctgcttttcatggccagctgggagagtttcgacaagtcaacctctcagagtctcagcattcctctttataaaaatgggcacaacaatgaaaaaccgaaaatcaaaaaaggccaaacaatgggcacaagatggctatgcagctgtgcagccttcccgcggggcgcatgcgcatgcgtgcactgcacaggggcgctgtgggctaccagggcgcaggccaccccaaccacccccgcccccggccgccgactctgccctgcgctgctccccactgcgattggcctggctggtggctgtggctgctgtgtcctcgcccagccaatgcccctgaggatcactcaggttccccacagggctctcctgttcagtcactggggcggaacccagtgggagctttctcgggttgtgactgaccgcagcttcctctcactatctaggcctgccggatagccaccttgctgggaattcttaaaccttctggagctctgaggtttgtgtttcttatttttgaatatagttatacatttatttggttttaaacacattttctctcattcttgggggctctgtgagtgggaaggagaggcggtggtgtttggttggttgacatcatgaaaccaaagtatcacggtgtaattttactttgcgtttctttggtctctagtgggattggaattgcttgtttatgatattccttttattcctaaggagttacattttttttggggggggggggcgataagtaaggtcttgctctgttgcccagtctggggtgcagttgtgccattgcagctcactacagcctagaactcctgggcttgagcgatcctccctcctcagcctcctgcagagttaggactacaggcatgtgccaccatacccagctaattttggggaggttttgggggtgggggtagtgacaggatctcactatgttgcccattcttggctcaaactcctggactcaagcaattctcccacctaggcctcccaaagtgctgggattataggcgtgagccaccacccccggccacgaggggtcacatttaaaaatgatcccaatgataacttagatccttgaaatgaaaaggcaaaagaaggctaaggaaaagagttcaaatggtgatatctgagtgtgctacacaccatgagcgccaatattcacagattactggggaaggtgctgtttgcttcttcactgctctgagagatcaaagttcttcctaaaaaaaaactactcgagatttacctttcttgctattatctacttattctccctttcagtagcccagagtgtaaggttcatccctttttggacaatttaccaatagttttcttagtactttgtcttttggaatgtctgctgttgcacctcttatcaagcgtgcaccccaggtacggaggacagccacccgtgcttggaatgctatttgcattgacacaacccaacattccactgttgttgactcttagtaagcttgagggaactaaaactcatttttaaaaatgtagttattttaggccgggcgtggtggctcacgcctgtaatcccagcactttgggaggctgaggcaggcggatcacgacgtcaggagatcgagaccatcctggctaacatggtgaaaccccatctctattaaaaatacaaaaaattagccgggcgtggtggtgggcgcctgtagtcacagctactcgggaggctgaggcaggagaatggtgtgaacccaggaggcggagcttgcagtgagcagagatggagccactgcactccagcctgggtgacagagcgagactccatctcagaaaaaaaaaaaaaatgtagttattttattatttttctcccggttgtgaatttggatagttgctttttttttttttttaatgtaagaacctggctttacattgtatccctattatatttcgtgttgttagattcatcctacccatctaggccgtcaaaggcttttggatcctgactcccatcggatattttagctctccttccctgctttataactttcacttataaatgagaagagtctgcctctgggcttcacccagccactagtaaaatactggagagagaaggccaagagcagagccaggcagcacatttccctaagagccaggagatttcagagaggaaagtgacccctgtggcaaaaaggacaaagtggatggcctgtgtgtgtgtgttactggcagtgcctttaatacaaggcaccatactttttaaaaatatgaaagtgcaggaaacttagcatatcaaaaatcaggcttgtgctcaaagcggagagtcacagactacaggcacctaaaacgggatgctacccttgggctcttcctgcctgcattttgcctccctgccaacgtgagatgcgggtgagaagtgagggctgagtcactgtcactctgcaccagttccaggactgctcaagtcttttacccacttctagaatagaaaagaggtcagtgtggaaagagacgattctgaagagggcttcggtgagcagttatctctggagaaagctgtgcctgactaacacccagcccacctaccaacccccgcaactttcccccaaccccaccccatcccagacgcagaggcagatgccagtcacaggcattgcaacagaagcacttggtccacgtttgaccacgcttacttctataattatggcaactgagcgtcttggacaaataaccaataatggtcttatcctcaatttacttaggaagttttttttttttggacttctataatttttaagcaaacatctgaagatatagagccattcttcctattcatcattaataaatcttctaaaatgtcattatatatactcagattatatattttggcatgtggtaattgacgtgttctttgaaattttagaaactaaacagtgtttagcttagttccctagattgttatactctagaactgttaagacttataataacataaaaatgcctcatcctcagtctttatctgctcttttaaaacagactttaataaaatgcatcagtgactcaactatccacatccatgtgtcatacttaaagggtagataactaagaagaggctgttaccaaacaacttgtatttttatacttaagaaaattatagagaaaacataatcttacagaaaaatatataatataaagtaatttagtgaattagtctcaaatgcaagaaaattcactgttatttttctttctttagaagcctggaaaaacaaattatttgctgaacttagcacttcagttttctcttattcaggggagaaaactctctcatataaaatgtaaaatatcttaatatttatttttataacttaaattgacttttcttctccatcaaatcaaatgcaatggagcaggagttctgtgtttgtcaccaatcctttattgaaactggtaacttacacactttataatagaacaacaaaaataatgttcaatatatacagccttcgcatggactatctgactatacacaggcagagtgataacacaatctaatcttcatcataatctgtgcacaaaaagacaccaaacagacaacatgtgcacatcacagtgaaatgacatcacaggtccagtgaaaattcagcataatacaaaatggactgctctattgcaaatgacatctttctaaatgcccagctcttactcagtagtaatttacccagagtctgaagcagagattggttgtgtggctataagtctcttgagtgagacaacctctgcagataagtttgctatcccctgcttcaaatacaagttctctgggtcagaaactttgtagccactgtctttcatttcaacaactccagttttgaaactattctgagttttgccactcagttctttttgatgccagtgctccgatttgagagaccaatcttgaatgttagtcacttgcactgagaaaggagtaagagaagaatgtaccatacttggggcactatgcttttcgagttcgaaatgtcttttagatgtcatgtcaataggtgaggaaagtttttgcgtggcctcaaattcattatcaaaggcttctactttgatctgcatggctttggctttgatccggagcttgtgtggcaaggcagaggaattcacttctggaactttaaccacagttgcatgcacatgcttgagttcaactggagaatggatggggcccttggggacctgttgctcgtcttctccatcagatgactttcctaccacaccatcatcagtttccgacgttctcggggagttgctggaggatcggttgacttgcagtagtgggggagagtgtgagtacccagagaaagaattccccatatagttttgatagatggacgctgtgtaagagcctcggtcatctcttggctcccttgtgtagctctctaattccatcggctcttgcttgataatctggaacttgttttcaggacttctgcagcttccctgcacagagctctcctgcgtgtgttctactgaggacacttctgaaacatcggacagcgagctttgtggagagtgtttaatgacagaaatacaactacttgacaccatcgagggttcgtgctcgtccacaaatgaactcacattggatttggaagtctggtaatcttgaaagtacacagctgtagaattactgagtttctgaatctcttgagcatatgctgtggagctaattaaaccaaactttaattttagtgaaagcagctcagcttttaaagtggcgttttcttctcccagtgcaattagtttgttctctaaaaccaggtcattcagtcgacgcttctcacgagatcttttggcagcttcattatttttccgccttttttcccaatacatagcatctttcttttcatcaggaatgaattcccgtttcctccgacatgcagaagatttgttcttccccacacttccttcactgagaagcagctcctcacctgttgtggagtcttctgacacttccgttaaagcagaattaaggaccatcatcttgtccacattgctactggcatcaagagacgcctgctcctttttgacggtctgcatttttctcagctgcatcagaaacaaccttaccctatctatgtgtgtaggagaacaaattaatttccccgtattctcaagctctttaaaaactctggtttaaaatccatcaatattcttccttttgttctaccgtctgggataaatccgtcaggctccttattgaatgaagttgggcctccttcgttatctgcaatacatgaataaaaaaaaaaccagttattcactggataaatgtttattacaaattatgtacaaggaaatatgctaagcatttagggcatacaagcacagatgaggcatggccacagttctttctttcaacaagttagcattttcaaaaaggaaataagttcccaaatacctaaactataaagctgtaaaggacaaatccctaatgaggcctatcagtaagagaatatgtgatccaggaaagtgagggaaaaataaaataacctctgcccagagagaagtagaggaaggctgtatttaatgaggcgaaatggagaaatagttgggtgtgggcaattacaggaaggaaatgacagatagcctctggttggtaagtttctaaacagtacatgcataccgtggtgcttctaaataatgttacctaatatttacatcactgccaagcagatatgctcacctcttaaaagggactttaccaagtaaactttaacgtgagtaaaaaaaaagttctgcactcctatatggaataaaatacaaatggagacaaacttcttctacaaaaactaaagtaaaagccacattaacaacggagctgttggttttaatctacaccttaacgtggacataaacctgcccatcacatccttgactgcctggtaggcttatatcccagcaaattccaccaggtgactcactgcaactaaatgaaaaggattcttctccatcaagccatctctttacaagcatctgagtttaagagattagaatttttttttctgattcctttgaatttgttctatcaaacattcaagattgaagtatccaaaatgctttttgtgatcttgaaaattctgtcaaaatagatttcaggtttcagttacatagtagctttgaactaaaaaacagttactaggcggggcacggtggctcacacttgtaatcccagcactttggtaggccgaagcgggcagatcacaaggtcaggagatcgagaccatcctggccaacatggtgaaaccccatctctactaaaaaatacaaaaattagctgggtgtggtggtgtgtgcctgtaatcccagctactcgggaggctgaggcaggagaattgcttgaacctgggaggcagagattgcagtgagctgagatcacgccactgcactccagcctggtgacagagcaagactctgtcaaaaaaaaaaaaaaaaaaaaaaaaaccccacacaaaacaaaaaaacacttactattcaaagggggtttttaaaagtatagtgcattcttgaaatgaaattcttttaaaccaagagaatatagttacagaaaaaaatttctttcatttatatgaattagtttcaagtaaaatataacaactcaaaaatagaatcattcattagtttcctcttccattgatgaaatacttacactacaaatttggcctgacagttgccttagctcgagataataaaatccatgttatgttccagtagcaatcattgcatgggggcttttgaatttaactgtgtttctagacactgattctctgcctaatgttccagtcagtaatatttttcgttaaatagacatggtacaacagttccatcagcacgatctgcacacagtggcactttattctaccctactaaaaagatgtaatgagccaggtgtggtggctcatgcctgtaatcccagcactttgggaggccgaggtgggcggatcacctgaggtcaggagttcgagaccagcctggctaacatggtgaaaccccgtctctactaaaaatacaaaaattagtcgggtgtggtgacaggcgcctgtaatcccagctactcgggaggctgaggcaggagaatcgcttgaacccaggaacccaggaggcggaggttgcagtgagccaagatcgcgccattgcactccagcctgggggacaagagcgagacttcgtctcaaaaaaaaaaaaaaaaaaagatgtaatgttcttacatgatgccactatctccttcttacgcctagtttcataatgactaataaaatgaagtttacttttatcaattggaaaagcctgccagcttcttttgtcttttccagggaatgaaaggaattatgtaataatttcaggatcataaagaataatgtttcatgccaggtttttgcccattaaactgagccaacatagttaagggaacagctagtcgtaactcagagaaatttgtgattattaatatcaagtttctgtttgttttttggtaatgaaactttaataggaaatgaaggcaaggagtgtgtcacagtcagcagtgatgttgcagagaaggaatcttcctatttatcatttaaacaatattatttccttttttttttttgataagagtctcgctctgctgcccaggctagagtgcagtggtgcaatcttggtgcactgcagcctctgcttcccaggctcaagcgactctcctgcctcagcctcctgagtagctggggttacagttacgcgccaccacgcccagctaatttttttgtatttttagtagagacgggattttaccatgttggtcaggctggtcttgaactcctgatctcaggtgatttgcctgcctcggactcccaaagtgctgggattacaggcatgagccaccacgcccggccaacaatactatttcctctaatttgcatttaggttttgtcctctaatatgaaaacccagtttcctttacatattgaatggattctttcctctgttgaagtctgcactctgccattcagcaaagtcctcctgctaaagtaaaatgagtggagaagtaaagaggaagatatcccagttaaagaagacaattgcactgacctttcccaaggcacctttcaaatctccactatactcttggccactacttttttccacttttagtttttaaacatcatatgatcccttgcagactattattctggttattttctccacctgagaatctttctcttccatgtgttatcttatttgttccttcttaaaaaaaaaaatcagattcctttattttgcctcacttactagatttacagtaatgcttttgaaatgccccgccattctgtctgccttagttactcttcctaaacttctaggaccttttcaaggttggggcccaattgggaaggagccttcacaataggtcctatttctatttaactgaaatagccccatttgtcttaaaatttccttaactcatgtcttctaggtgtctaagtactatatgactactttatcatctctacaactttgttggtacattaacctacagaaaacttcatttgcttttttgtttttgagacagagtttcactcttgttgcccaggctggagtgcaatggtacgatcttggctcaccgcaacctctgcctacagggtccaagcaattctcctgcctcagcctcccaagtagctgggattacaggcatgtgccactaagcccagctacttttgtatttttagtagagatggggtttctccatgttagtagagatggggtttagtagagatggggaaactccatggggtttctccatggggagttcaggctggtcttgaactcccgacctcaggtgatctgcctaccttggcctcccaaagtgctgggattacaggcgtgagccacctcgccaggccacctcatttgtttttaatcatcttcttcctatttgaatttcatggcatgtcactataaatctgtgattctgctctcatctgtatgtattacattcatggtctctacaactcaatggcaaatcaccacactatcttaggatattttctgtaatattatctatcaaataatcttgcagtgttgaaaagagtttatcagcattatgggatgatacggagacaggcacaatcatatacactgtgtgtgtttccacgtgtttgtcttttgtgcccaactacactgcgaattacttcagggcggaaattaaaatatacttgtcttctagcaaaaacctgaagatattaggtgctcaacatttcattgacagtcacccatataccttatataagagagttttgtaaacagaaaacttttttgatgctttctttttaatgttatgtgaattgtaaagaagatattttacttattaacagagagattctcttattcattaatttgtttattcaacacatatggagcacctactgtgtactgggcacaaggggagactaggggcacataaagagggagagaaaaaccaaactcccgagaccaggcgctcagtcgtgggtgggtgggagacaaacaggtgagcagaggggaaccaggtgtgagtgcagagttgcacaaacatgggcctggggtgcaggctttcttcttgtcatggagataataacaaaaacaatcataattggtgccatttattgaacacttaccacagaatgggcactgggagcctgacctgctttctttcattcacttttggtgacaattttcagataagaaaactaaggctcagagaagtcaagtgacttgcccagtgtcacatagctaaatggcagagcgtacattcaggcccagttcctttactctctcctacactttcacaggtggttctgcatctttgcaatgcagtctcatttacacacagttctcttttgtgtcactttcatttctgagtaatacatacccttttactaagttactttgggcgcagtaaggcactatgctaacttaactacttcttctttttttttttttttctttttgagaaggagttttgctcttgttgcccaggctggagtgcaatggcgcgatcttggctcaccacaacttccacctcctgggttcaagcgattctcctgcctcagcctcccaagtagctgggattacaggcatgcgccaccatgcccaactaattttgtatttttagtagagacggggtttctccatgttggtcaggctggtcttgaactcccgatctcaggtgatccgcctgccacagcctcccaaagtgctgggattacaggcgtgagccgtcacgcctggctccttaacttctcttagatgctgtcttaacttctttagccagcaaagatactatctagaacttttctccatcctccttagatgtttcagatctggcactatttatgaattgagaaaacattttattaattttcatatctttactaaaattttaacctcctggctattctaattatgttaaatagagaaaaagaaatatgatagctgtggacattgtcacctatgatcttcttcttttttttttttttttaacaaatccaagagtgtaatctgttttcaacatgaggcgggggacagtgtctctctgaccctctcattttgcagattaatcagctagaagacaggctgaccttcccaagaccacacagcagttgggcacagatgggctctgagctctccttatgcccctcaacaatgaacttaaagcaaatgcaaaagtagtttacgatgccttcaaaaagcctcaggatttatgctaacctaacaaatttatttcaagcctcaatattttcccttatgattaatttaacaattacttcatctatgcatcatcttttcaaatcaacatctaatgttgtggtatattagtcattgcttaagtttcttttttggtgaataattgacactacatgccaattctatgatgttagtgtattcagcacgattaacttcattacacacattagatgatatgactctccttgaaaacacaaataaaaaagagaaatttaagagcaggtattattacctaccagttgacatatttttccatacatactccgaaggtgccatcactaattaatgcttttgtatagtccatcacactacttctctaagcaagaattatatagcaagaattatatttcataagcccagatttttaaagtttaagtcagattaccctattgtttttaattaagtacaagatttgatttagaaaattctataaaagaatataacctcataacaataattctagaccaaatttatccttgaggagttatctcattagttatgtttatgatagacctttatcttccctggtctctcccagaactaatgtttaacaatccaagctccacaaaagaaaagaataaacatgctttgtttcaatcatctgaaatcttactaatagtctaaacattaaaatctactctgagaacattttgttattaattatctataaagggtaagttttattgcaaattgcaatatatattttgtttttaaaattctgtcaatagaagatgaaatactatttgatatgcccaatgatttggaaacattatagaattatcttattttccctctactctctgaatgtattgttttctccctgttatataatacagataacagtaaaggaaaaaaaaatgtcttcaaggtaaacctaagttatgttaaactgtaagccacctctccagtaagacagcagatgcttattttttagataaatgtcattttcatgaaaaaatcaaatcaattaatcaattcacatctctttatacttttaaagtatgaatactagcaatatgttaaccctacattttcttcctgtgggtaaaattcacagtatctgcgtcaatgaaatgctttacttcttttcatggatgagaaaacaatctagtatttaaaagcagagatgaaataagaaaagaattcactatacatgtacaacccagaggaaatggggagtgaaaaaactcagtcagaaaacaccgaagttgcaagagaattttctaatcccgttgaaaaagagaaggatttttaagctgagaaaactatgttaaacctctctaagggccattctgtccccaagaagcagcttaccccaaagttagagagaaatgtgcacttgatcaagacaggcaagacgcacacacacacatacacacacactctcgcacactgccagaatctattctatcatagcaacaaattgacctactttttctatttgggtgcctctgtaaataaatgtgtcaaagcctgatccagtttatgataaatgaaaatatttcaagttcgacaaaggactagctgaaaattaaatttaaatttaataaatacgatgacaacattgcattttattacatcactgatgtaatttaagtaattgaaatatgaaatagtataacttaacattcttctttaagaggtcgtcagtgtttgaaacttaatacacaattaaattattctgaagcctgcacagagtaagcacatacacgctagcacgaccaattaactgcacagcttgagaaataagaacagctctcactaaagatgggtagtaacatgggggaaaaacagaacagtaataattttttaaaaatctatagaaacttaaatgtggggactattaatatcttgaaacttctgaaaagataactgatcagtgtagcaactaatctgaaatcttaaaaggacaccaacaatcacaaagtaacccagttgtagaaaattccccaatgaataagtaatacatgcaacatggtgtaatgatggcaaaaatggtgggctaaggggacagtcaggctgagaaaattcttgaaagtttctaatgataatgtagaatcatcccaacttgcttcacttggctttttaatttctttttccacttttccagtcagtggatgattataaatgtcattttctaccttatgaatagagtggattttcaaatgcttatttgtagtgtttatttgaaggccagttaattacagtttaagacccctaaaaagctaattaataaaagacatcatgttctgataactaaaaggcttataaacatcattctgagtcctatgaaactgagtcctcaaagcacagattaataacaaatggcatctagcaaatctctagtaaactttcttatcataaaaacaagtttatgctctattattaaagccatatgagaaacagttttgggtgttttttttttttttaactacagtaaagttacttacaaagaaatgtgaaagataactggggtagtagtaataaaaattcattttgaaactgaaaaattcatattgtaatgtctgtgatcaaaggtcaacgtctttcaacattctcatacaagtccaacctggatagaaatcaactcaaatataatttagaaaaataacaggatatcaaacaatgtattaaaccccgtgaaatacaggcataccttacaaaaacaagaaatgaatattaaaggcaatttcaattacattgtttctgttatattttgaattgaatcccaagtgtgctctcattcctcaatacaaattaaaaataaacaactttaacagcatcaatggcatctggattacaatggaaatcatgaagtatatgagtttaacctgggtaaaaataaagcccaggcaatatgactgcaccttttccattccatgctgcaatcgcatttacatctcgaaattgactctaatgaccaaggcaaggtcaactagaaaaatccactcagctggtgagtcaggcacattgctcaacgtccgaaaggcctctcacaaagggttttaattttcaggctgttgcatcacagtgatgttataactgcactgcacaaaaataagtctttaacccagaaaaggaaattgtttcaaaaactacagtgagtgtgagaatacactttgttgaggtgcaaatttccccatctggttttcaggctctgcgacctgggctgcaaattcatttctctgagtttccatttcctcatctatgaaatgtggatgataacagagcccctcaacactgtgcctggcacatgcagagtatgtgtttagtaaatactaactctttatctcttttctgaagaatgatcagtatcaaaaggcaacgatgcctatcagttccaggctgtttttgctgctcgtgactcttactgaagccctgacctatgtcgcaagtgtaagggtaaaccaaatgaaaatttggtcaaaagggtcaaatatcaacagtttcacaggactggccttagttttcaggctacatataccccctacaagagagcttatctgtggggtctcaccatccactgctgatctcagaccacaaagttttagatagagaaatcatccaagctacagaaaatgagtcacagaatgtgtaagggaattggaaaaagctgagctattaatatggcaattgtcacgtcattcctgctactataatcgactcatctctctattccttcaagcagctccccaaaacattaacccaatgacttgggaagtttgaggttctgcaatcctgtcaggaattcccctcaaactgaaattaacattgaacacgatggcaaattaaaaaatatatatattattagaacaaaaaaagtatctcaagaaagatcttacagacttaattccaacacgaatccttactgttactgcgaagagatttacaaagagaaaaatgaaggtaaatacacacacacacacacacacacacacacacacacacacagattctggttcctgatcaataacacaggaaacatttattgaactcctcacaaccaactaagtcaacaggttttattccctcagtttaccctggagagtgatggaaatcaggacagtgttggaagataacaagctggggcctgggacccagggttcttgtgagcccagggcctgcgctcttaggatctgtacctcaccgaaacctgttctctaactactgcctgtaacaggagggaaactgattagggatagcggtgtagggtatgatgccaaagaaagcaagttttcggtcagttttcaacaaagagcagattgcgttgatatgcttcaggagaacatctgtgatgtctccatgaattactgcatgggtacaatcttggaagtctttatgcgaggatgaaagtactgtagttttacagtaggacagcagcgtctatgtgggcgtttagattttattttgaactctggagatcagtgttctctctcctctagcctttgaccacataaattaaaggttaaaaaaaatcggctcaactcaactggccaaagtcaagctgaggccttccttttaatcactatcaatactggagcgcctccacccccaatttctgtggccggtggacgtttggaggtttttcttaaggtctttttcacttcaagaatggagacgcgcttggttccgaaatacaatgaagactcttggaacaaaggtgtctgcaggtttctgaacctcaccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcggggtctgaagctgggggcctagagcaactagcttcttggaaagcgactgcaattatttggggtaatatactctgttccagagacgtccaccccccacctcccacaaaaaaaaaccctgcacttaatttaaatgttacgttatatatacatcccatcatatacatatattcacacataatcactatgtaacagtccaggaagaaatttaatatttgggtaaattacatattcacacatcttcacataagtaaaaccagggtatccagacaaaaaaacaatctactaacctatatctgtttcccataggtcatatctggtctgggggtaaataaatacttctgacctcacttactgttgttatttacaaaagccaagaacagaagatgacacttggccattccctgctgttctcagagaacagcagtttcctaaagtgtcctttaaaaacataaatgggagccagcatccagcaaatcaccgggcgctgcgaaatgccttcctaaaaatacaatcttatcaaaggtctccgaaggcgtggagttaaaactacagcaaatggccttgaacttgtatttgcacacagccctggagaaaacaccagaaatagcactgcgaggccacaattgttaaaatgtgatagggctaaatttagaagaacgtgcgtttcatttagggcaaaagacacacattcggcagcatgagcaaactccatgcttacccggttgtctactttcctgtttaaaatatccttaaggaaaaaaaaaaaactgttatagtgacattcttaaaggctgagactgtcctactttctttgtagcaagattataaaatcacgtaattagctccctctctctatgctcactgccagcaaattcggcagttacataatgcaacatttccaggaaactattatgtgatttgtcttgtcgtgtctgaaaaagcaatgacaataaggtgagaaaaagggctgatcgaatggaatgcattaaaattaggaaggtggggaggtaaacgtcacaatggttcgtcccagatttaaaaataacagctgagaacattgaaagggcgaaccccagtagtacccaagatcagaattcaatgcgagcaattcttgcttttaggttttgtagtatcgttttaaaacctgtttatttgggacgtaatatagacgtaaataacgatctaatatccaacgctgcgcctcaattaccaaatcattgcacacatacgcgcatattcccacatcagcccgcaattcttgccaacatttcaccgtgggcagattatgcaatgtatgaaaggacaaatcccacaaccttcccgagggcttgtaaaacacgctgacgacaaacagggtggaaaacgtctgtgcagacacagcccctgacacaaacaaacgccgcgcaggcattctccgaatgccgtcaccgttcacgctaccaaccctttttctcaccaagcaaattaagactattccccattcctcaaccccccattcctctcccccctacgccgccagccccagagaaggaacgagaaagaaagacactagagaggaaagagcatcttcccgctcggagagggctcagcctgcctggcgctcttctttaccaaaacatcaattttcctgaaatcaggagacattatgcaacagcagcggggggagagcgcaaaccagccaggactacgtgccggcgcgaaggcgctgcaatcaaagcagccaccttaaggtggcgagtcccatcctgacaaggcagcaaaagtttatgtaatgaatgccccgcgcgcactcgccgccgctggcgagcccagcttacagcccgaccccgcacacagcgcggcccgcaccccgcgcccgcccgcccgcccgcagcgcgccctgggagcggtcgccgggcccccggccggcggtgggcggagcgcttaccgtgttcctgctctcgggccggcgaggagaaagaaaggggcggccgggagtcgggccgccggcgctcggggctcgggccgggccgggcctccggggccgcggcgggaggcgggcggcggcgagggcgcggcgcgggaggcgggcgggcgcgccgggtccgcgggcgccgtggccgcgcggagagatgtgtgttagtaggtcagttccgagcgccgcgctacgtcgccgcccgccagccccgcgtgactggcggccgcggccccaatcgccgcgcccgcacccgcccccggcccgccgccaatggccgcggccggcaggggcgggccggggcgggcactccgcggccccgccccgcctccccgccctcagctccccctccgcggcggcgccactaccagctcgcgtccctccccggccagggccaccgccgtccgagcgcccgcgagggctggcgccccattcccggcgcaacgagtgttgcgcaacggcccacgcggccgacacgaccggagcgagcctgcggaggagcccgggagccccccgtcccaccgccccgtccgctcttggctcccttcaccctcccggtcgccgcggtggctctgcgctccccgcgaccctcacttgctcgcagaggcgctttttgtcttcctgagagccgcagcctgctgggctacctgttgccgactgagcactgcgggttgcggctacccgggcgtggcccggacctcggcctccccttccccgcacactcccgagaggagccctctaccttggggtgggcaggagggaaggcggggggtggcggctggcaagctgccaacactcggggcgcgctgcggcggggaaggggttggcgcggccgggcagctgcgcagggctgcgcggcggaggcagcgattaaaatgtcccggcgcctctcccgagagccgcgacggcccggagccgggagggaaagctccacgcacaaacaccgccccctgcacaattagggcgaagatgacggctgcaaagttgttgcgtaacacgactgggaaacgaggctcgctgaggtccatctacccacccccgccacgcgggtgcggcgttcctcggaggatgtgaaggtccgcgctcgggtgcccccgctgggacgcccactgtcgtttggtgctggggcttgagacgaccgcgcgggatctcttcctgtgattttgagctgatagctgcttagtgttatttctgcgtctaactggatacggtagtcttctctcccaaattcccgggctacggaagagacgtaaaaaaatggaaaaaagagcacctagccgcgacttcttaagtcgtcgcgctagactgtcaaggcacgtggcacactccctgcgtttaccgatacacggatagtggtcagtgctggccttggcgaagggagccatgttcccgacagtgactcacaggcttgcccaaatacggagtgtggcaggtgggcaggacctccaccagccagctccctcctggtctccttgaactacgtgggggctgggccgagtgcctccacgactttccacttctttttgctcctttcgtttttaaaaagcaaaaaccaaagtaaagagaagagcagagtgaacacccaggtaccatccctagtgtctgccatgagcagcagatctatctactcgccaagattgtcttttctacctttccccttcttgcacagttaatatcataataacgcaagtcatatttaaaaaatttttatcacctatcagttgagtttttggaaagccttccagggcagcgttgtggttttgaacgcactcttgttcgtgatttatctggtagtacagctctgctgacaaggctctgaaaactcagacgtacaatatgggcttagcgtgttccccgacaccatcttcccggtgctgactaatgcaagaaccacatcccctccactacacattttccaaacttgactaccttcatgagaacaaatcctgattttagtttataatttccacttttctcatacatatataataattcaagatgtggtcttactatgttgtccaggttggcctggaactcctgggctcaaaggatcctccggccacagcctccctggtagtggaattacaggcgcatgccactgtgcctggccacttttctcaaatttactgatagtttcctttttgcccaaaccttacaatgcttatttgtagctttgagaacctctcttagatgaaatcaaaatcatatccatattagttgcctttttggggtcagaaatgcagctattgtctagaaatccagggctgtcctgcataatctaccctccccttcacgtgttctgaccttgttctgcattttgaataatttcatggaatttcaaagccgttgtagtaaatgtctttctttaaagacaactcgaccttcaagacaggtaaagaacgtgcctggagccaccccaggcagtgatgctggaggagttctctcaacctggaaacttattctttatgctgaattttgaaatcgaatgctcctatatttacttggagtattttagattgtgtatgtattatatctgtgcatcattcattgttaccatctaacttggaaatcagaggaagtgtgaaaggtatctgagataccagcttagaaaacaactctttagctcctcctggtgattaggacaccactaaacaacaggatgaaggatctgtccccagggccgaagtgatgatgtatctaatattatatcctagaacattcacagagtaggtaagtatttgcagattaactcgagtaaatggagcataaaaacctaagatatttgaaacaaattaaccagggtggggaggcttctaggaagacatcagcatgtgcctgatggtggagctgggctgtaaggttctcaggaggaggaggaaggggttcttgctctcagcaacctctcagtgctaggggtggattgagggcaggggcaagggaggaggtgcctggacagggatgagaactaccagcagaagacaatcaaccacattctaattcattttattatactgccaacatggtttctgactaagcaaatataagagctatagcttgagaacagaatgactaaaacagtgacttctccttactaaaatgggaattaataggaatttgtaatttagtaacaacttaatttaatatagtaataatttttctacagctgcagaatgtcttgagctggaacatccccaagaggccatatatatatcccagggattttacagtggacctcactaggccggagtaactgtaaagtcagatggataatgagaattcaggacgttagccacacgtggactgtggcaaaaagaaagtgacccactgaagaagactgtttttcagctctctcatcaattgctgtttccaggagcccacagctccaattactcaaaagaacgttgacttttttttttttggtaaaatatcctgattttcaggttaggcaagcaattcattaaaaaataaaagactgcacagcccacagctccaattattcaaaagaaagttgactttcttttttttggtaaaatatcctgattttcagtttaggcaagcaattcattaaaaaataaaagactgcaggacttacctacccagaggctggacagtctgagtcctctgagttctacagagatgtcctgggaacagggggtggagacgggggactcagtggctaaaaagcaggctgcctacctggcaaccaaattgggcagctctaccctatctgttttgtgcattggacttatggatttctttgtagaaaaaacttcgataactaaaagccctttggtgacctcctgtctggtctggtggccggcagcctgcatcagggctcctgtgtgccaggaccattttctttccactgtagtatgtttatggaccaccttgtgtctttttattaaactccaggaacagaagttcagtttctgggaatccatagcataccgtttttgttgttgttgttgttgttgttgttgtttttgtttttgagacagggtcttgctctcttgcccacactggagggcagtggagtgatcacggctcactgcagccttgacccccccaggctcaagcaaacctccaacctcagccttccaagtagctgggattacaggtgcacactaccatgcctggctaattttttaattttttttttgttagagtcagtgtctctctatgttgcccaggctggtctcaaactcctgggctcaagcaatcctcccaccttggcctcccaaagtgctggaattacaggtgtgagtcacagcaccagacctgttttgttttcaagtggaggctttaagatgtgagctagcatggtagccttagtgaggttctcctccccacgcccatcagtgtgtgctttttgctgggattttggctttgatgcaatgagtcattgactgttgaggcagaaacttcctggaatgatatttctttccaccactcatgcacttttatttctgctattcatgccatttttaatctttcacctctgtcttcctcttccgctttgccttttcttgtagtttttctacctttgttgaccttttttctttttaaatttagttatcttgatttactctattattcttagttttttcctttggcctttctccagtcattcagatcattacttcctgggattccttcattcccccaaacatccacttttctctttgctcttgccacctacctatcccagccacaacctagacgttatagtttttaagatttcaactgtcttccagcctctgcctctcggtcccctaactttgccatgtggctccattagcaggagttctattagcatgcttggccttctttttcaaaaactagcttttgtgggaaattgggtaatagaagatggtcacataacattccctgtagaagcgatggctttaaagtatgggaagccaaaatgtttcctattaagcagctcttgctcaagctaagaaagaaattagatctctacaccaacgacatgatttccccagacaaaatcagctgatggtctgaatacatttgaaagcatttccaaaggacccaggaaaagaccagaaagaggtgattttgcaaagaagagaaaatgttgcaagtacactattacaaaaactgaaacatgtctttaaattcagccaccacagatggcacacatttcagtaagcatttttattcattcagattaaatggtatatgtgagtaagagtgccaaaataagggacattaacaaaaaaaggtgggtaggaaaaaggagaatacactaaaaatggtcaagactgtgggagcagctaatcgtgttcattgcaaaatcttggcgatggagcaagcattgtggcagcactcagccagcaactggaacacagctagcagggctatgagtatatgaaatagaaaattgtgaaatatgttctaacaaaaatcatttcatgaagaataagacaagacaggtccacattgcaatccagttcaaatcaacgaagtaaagcttatctaaacatttctgtgaagtcatgcacaggatagtttactggaaagagctacacagctgcaactcagaagctgaaattctggtgcattctgtaccccatactcaccaaggggatcatttcacctctctgaatgtccattccttcatctgaaacccgagggagccaaccagatggttggccacgttccttctctcattagcatgggttgactaacatgccaccagcatatattgcagaaaagaaaaactgcaaatgtggcatttgcagcaaagcagctatggcaagcactggctcattcataaccttcccttggcctaattgtaacatggacaagagaaaattaccttgttgagttgcccaccaacttttgtcactccagagacaaaagttgtcttctggagtcgtttgtttcagcaagagattaaagtgaatgctctccgtttggtaaatgcacttaagaagtccggaaattgggtgcttgaccgcatttctggtcttctgagaaactttcagaagtgctcaagattcaggtgccattgtgttttcagctgctgctgtgtgatgctgctctcaggcggtgcatgtaggtctgtggaggattttgtgagtccgcatactggcaggatgataaaagagccagctctcgggcagtcaccaggaattgcaggcagtagagcccagtgctgaagacccagatacagaggcccgtgtccacatcccagcttgcccacagccactcaggaactctgtggctgtgggcaacttacttttctcgtctgctgtgtgcctcactttcaccttttgacaaccatttataattatagtatcaatctcaacttgttctgaggataaaattagtacctattaactgattaggaaagtgcctgatatattagcaagtgttagctattattattaacccaaaaaagaatcaacatacatcagaaaaatagtatcatcaaccaaatacttgtgcctgtgcatgcgtatgtgtgtgcgtgtccatattaattacatatacataataaatcttgttacgctgccaggatcctattcaattcagatgaacaagtgagcatgtacatctacaagaaagaataacagaggtggatggggattagaattcattcattcttccatttatggagcacctgctgggtgccaggcatcccttgaacagttgagtgatgtcccatgcctgctgtagacttggcgctcattcactcactccctcacttaaggtacatgtttactgactacttagcaggggccagaaactaagccaggcccttagaggttaatgggaagatgaggatggtgggttaaaagcataactcgaatactgtcgcggtgtggtaactgtcactggaaagaccagactgtgtaccaagaggggcttgaaggagaggagacccacattccattgaagcagaggcagaagtacttcctgaaagagggtataatttaatcaaagtttttcttttttattaaaaaaaatgtttggtacagggtcttgctctgttgcccaggctggagtgcagtggcatgatcatagctcactgcagccttgacctcctgagctcaagcaatcctcctgcctcagcctcccaagcagctagcactacaggtgcatgccaacacaccaggctaattaaaaaacattttgtagaggcaggatctcactatgttgctcaggctagtctcaaactcctggcctcaagtgatcctcctacctcagcctcccaagtgctgggattatgaccaaagtcttaaagatgtatgggtattctacaggcaggaatcatgcctcaaaagagtaccacataaagccaggcctagcaaagccagtgtggttggtgaccaagggaaccttggggagtgacaagtcctggcagagagcttgatggaaacccaggttttgcaaagtcggcatgggagagcagtgtggaaatgtagaccaggcccaggcctaggggacctggagtagcaaaaccaaccagtacgttattcaggcagtacgttattcaagcatttaaaacacattgttttaaatgctttttttcccccaaatgtcacacattaagaattagtgtagggaaatggttcaaagcctggactctagagctgggtggccatgggtaagtcacgtgaaaccttgatgcctcagtttcttcatctgagaaacagcacaatagtactttacatatgctatatatgcttcagttcctctacacagtaagaataataacaaatactgctcaaacaccacagcatgcacacaccgtcttgggcgcatcacatatattaagatgtttcatccttctaccattccgtggagaggggaaaggtgtcacgggaacagagcctgagcttagggatgcactggcacatgctctcctgtgctattacaaagggtgtgtattcatcccacgagagaaagccagctggagactagaagcaagtggaatttgacttgaacagtttaaccacagtggaagccgacgtgactttggccttcagggagtgtctgtacttgggctatgctgctccagagttccttttgcttctgttcctgctcctggctgtctgggatggttcccagtgcaggacttgtgctgctcaatgacccaggccacacaagactttccccctaatgcataagtaaaacaccactttcctttgtaaaaatgacctctctgcaagtcccagtgtgtctccttcctggatcccctttgcctcacctgtcccaagcctctcttgcttgctactggacaggctttgtcttggacgcctttccctcttctaccaccagcagctaacttgggtcttcctgggttcccaatgctttcctgctgctgcaagtaagatggacagaacttacagatgggcacctcccatcacttaggaactcacacaagcacagagggccaggaacctgtctttcccaggggctaccggggcaggtgacacaaccccatgatgtagggtagttggcacactgtcaggttagttctgagccatgagtgacaggagatgggatggaaccagtagataaatacctcctctctacaatgtttagtggcatgatgtcccaaatcccagccacagtctgtgctgtcttggggcactgtagtcaacctggtagtgtaccttgtccttataaatgtacttcccctatttctctgtctcctcttcttttcctcctactcttgcagttctagaattgtacctcccaagaaaggcttagcacaggagatttgattcaggctccggtttctgggaaactcaggcccagccaatttctttcggaacctgtcaaagattcaaagtgcagcaatagtcccaaaaataggtttcctgaaaacatgtccctcacgaaaagtagcagagaaagatgactctcagtcttgcagagaaattgtccattttcttatcttttgcagtattatgaaaactgttgctgacacataagaacctatatattccagtgaagttgtttaggtttttttttgccagatcttaattctgctgtgcaaaggcagagctgaaaagaaatgggaggttgatttgtaaagcattagtgtgagaaggtcttagggaggtcttttctagtactcttttggagtatgatatatattgctaaagtagctggagagtagtcagaagtatagctattttgatgtgataaaaggaaaacattttgaactgcagactaggaaagaaaactttcttgttactgaaaaatatttatctttactactgaatatctgaaaagcattctttttcagtgtaaatttaatcatttaatggtgaaacaataaagtccttcctatttaagtaggaaaataaacaggaaactcattattatttgacatcattttgaaggtcttagccattgcaatgagacaggaaaaaaaagaattatcagtattacaaggaagttataattccatatgttcatttacttatgtagcaaaactaaagcttatgcaaaaatagaagaattcagtaatgtagctggacaagatgttaatatttaaaaacaaaattttcctgcatatgggaatcatttgtaatagaatggctaaaagcacacattctacatttattgctgtgactatcggcaaattgctgagactcattatgtttcagtttcctcctctgcacacttgggattgtagtcatgctgccctctgaaggttatggtgaggatattatgaatgagcattgctgcagtttgactcacacaagatctacttacaagcttattcatccagtctttatttactctgggatttgcaagtatcaaatactttcagacttccttgatggcaggggtggctaactgacatcattctggccaaacgggcataataagaagttgcaggtgcccctattttccttttctcctgccttaaaaatggacatgatgctagaactatagcacccatttgaccatgagggaagcgtcaatatcagcacctgtttacctactcctgggcttcttgaacatgagaaacacaaacctcgatttgtttaagtcattgttagatgagtattttgtgaacaatattttcatttgtgactgaataacatgtgaagcataacataaataacatatctggtgcctaggcagtgtttaataaatgttagctcttagtattttagttgaaaaatattatatttaaatatatttaaaatatacttgggaaaagtgtcttattcacaataagaaaaactatcaaataattaatactacatctaacaaaaaggtacaagctagtctacataaagaaaactattaaacattgaataatgactaacagaagccaaacaagtaaaaaaattgaatatatttctgattaagagtattataaagatgatgattacccccaaattaaccaatgagtataatctctcttaatcaaaattctaatggatattttgagaaacttaaaaagttgattctcaggccagacacagtgactcatgcgtataatagaagcactttgggaggctgaggcatgaggatcactggagaccaggagattgagaccagtctgcacaacacaggctctcatgagtgcttctaaacaatggaacataatatgcttccagaacctcagcttcatgaagtctaagacatgtttcttcagctttcaagcctccccaagtagatatcagattgcatgggagtagaaaaaaatggatgctaagtgtctactaaccaagggaaaatacatcatgttggaatcattggctagaccttcatctcattccaagcataaaaatattcccgtaatattaaagatttaagtgttaaattacacataaaagtacaaaaccaaaatatgggagaacaggtctacatgaaacccagaagttacaaaagaaaagataaatatatttaattaaccgtgaagcagcttttgtttgataaaagacaccttaaaattaaaagacaaaaaatttgagaaaatagttcacatttttattctagaaaaaggtttaacattcttaatatgttaagcactcttataaatttacaagaaaatcaacatccaataggaaaatagtaaaaggatacgaataattttcgaaaaaaatcaagtgcacctagacttcaccactatacaattcatccatgtacaaccaaaaatcgcttgtactcttaaagctatcgcaattaaaaaaaaaattaagaataggtggcagtttagatttgggccataggcctgtagtttgccaaacacttctctaaagggtttcctagggaatgtggaggtcagcatgaacatgcccaaggaccatggcaaggctgcctgtaggtgacataacagtatccgtatgagccgtcttctatgattccaggcacccctgtgctttccctggttttcttttgcattcccccaaagtacctaataactgaattgtgtgttttctctttctttctctctctctccactgcccccactaggcatagcaagtatttgctatgtcaagtagtggaagcatcaccctccttggatattcagtcctctaaatgatcagaacccagagttgtgagaattgtgataaaaacgcttgctgcaactgacttatacaataatacaatcatcaggcccctggagctgctggtcagaaaactccaacatctctatgaccttgcctgcctgcagcaattgctaactcaacaggaagtgtgcctcacctctctttcaccatcaaattttatcttaatttgcatccagaataccagttgcaagagagactagtaaatgtggaattcaaattctatggtacataaaaggccactcaaaggaggttgaaatggaacttgagtgccatttcatcatggtcctcatgaagcctgaccgagtccacctgcctctagaggctggatgatggctccgtttggcactgaatcagttttagagacatctgcctgcgcctgaaactgaggagtgtaggaagaaaggtctgccttggtgaagtgaggactatgattttgccacatggtcttcatgactaccattctattctgtgacagtggtcaaccagggtcccttactgagactttcagtgaacagtttattccatgtgcctacagcttataatctaattaacatttcatctatgcatgccaggtactatcagaactcttccctttaatactagctggatttttacttccttcagttacatcttgtacatcccatagttcactcaacttgctgagaatctgggagcaattttttacagcattcagggtactttgttgcaagcaacacagaccgattttggctaatatgagcagaacagtaatttactaaacaaaaaaacccaaaaaactccaggcaactcacagaatctgtggcaagtcaggtttgaaggctaaaaagccggaagctatgccccaaatcaaactgcagaattgatctcccgcaggcactgctgtctctgctgtaggacagagaaactgcatctgcatggcacactcctccaatgctgctaccagaaagaaagctcctgcaaacaggatacagccaccttcacaggcactgccccagggaaagagcctgcatgatctccatttcttcacattaccattttctgattaagatttgaaggtggggccgggcgcggtggctcacgcctgtaatcccagcactttgggaggccgaaggcgggcggatcgcgaggtcaggtgatagagaccatcccggctaacacggtgaaacctcgtctctactaaaaatacaaaaaattagccgggcgtggtggcgggcacctttagtttcagctactccggaggctgaggcaggagaatggcgtgaatccgggtggcggagcttgcagtgagtcgagatggcgccactgcactccagcctgggcgacagagcaagactctgcctcaacaacaacaacaacaacaacaacaacaacaacaacaacaacaaagagttgaaggtggggagctaaggaggagttaagtatgtctgattggcaggacctacgtcatatgccaggaccctggctaccaagagtctgggaaaattaatagaagatcttcaacttctctgattggagacaggctctataacccaaaataggaagaggttcctctgccaagtagccataaagtgacaaatgttcactacatccttcatatatagtcagttacaatttcctactgacactatcccctaaatcagcagtccccaaccttttttggcagcagggaccggtttcgtggaagacaatttttccacgtgcaagggttttgggggatggtttcaggataaaactgttccgtgtcgaatcatcaggagttacattctcataaggagtgcgcaacctagatccctcgcatgcgcagttcccagtagagttcacactcctatgagaatctaatgcttccgctgctctgacaggaggctgagctcaggcagtaatgcttgctcgcccaccgctcatctcctgctgtgcgggccagttcctaacaggccagggatcagtaccggtctgtggcctggggattaaagaacactgtcctaaatctcttttttaaaacagctttattgagttataattcacatccatacaatttacccatgtaaagtgcacgattcaatggtatttgatgtattacatgttatattttttggatcaggaatacatatataacaaaatttgcctgttgaccatttttaagaaaataaatttaatcatttatacttaagatgtaaatatattgtgggatacatgtagatagtaaaatggtcactataaagaagcagattaacatattcgtcatctcacacagttacacttttgttagtttttgtggcaagaatagctaaagtctactcatttagcaggaatcacaaatacagtacaattttattatctgtaatcttcacgtacatttgatctctagacttgttcatcctacatgtctgttactttgtgtcctctgacctacatctccccatttcctttctacctccctagccccacccctggtaagcagtgtcttattccctatctctgtatatatgactctttaaaaaattccacatgtaaatgagatcatgtatttttgtgtgtgtgtctagcttatttcacttagcacaaacttccaggtttctgcatgttgtgacaaatggcaggatctccttttttaaaggcaaaataatatgtctttatctatatgtatgtagcacagtttcttaactatttgtatctctacagacacacaggttgtttccatatcttggctattgtgggtagtgctgcagtaaacacgggcgtgcacatacctttatgaaatggtgactttatttcctttgggtatatgcccagaaagggggttgctgggccacatggtagtcctatttttaatttttttggaaactttcatattggtttttataatggctgcaccaaactacatttccaccagcactatgcaagccttccctttttcttcacatacttcctaacattcgttatcttttgacttttaaataatagccatcataatgggtgtgaggtcgtatctcattgtgattttgactcgtgtttcctgatgattaactgcgtttaacaccttcttacaaatttgttggccgtttttcatatcttctttggagaaatgtctattcaggttctttgttcattttttattgagttatttgtttttctgctattgaattgtaggggttcttataagttgtggatgataaccccttatcagatacagggtatacaattttttttcccaattcataggctatttcattttgttgataatttcctttgctttgcagaagatttttattttgatgtagctccatttacttatctttacatttgtagcttgagcttttggtgtaattaggggaaaaaaatcattgtcaaggctaatgttcaggcacttttcccctctagtgtcttctaggagttctatagtttcaggtcttaaatttaggtatcttatccattttgagttgctttttgtgcatgatgtaagataacagtccaatttcattcttttatatgtagaaattcagttttcctagccccatttattagagagactatcctttctccattgtgtcctcttggtgccttggtcaaaacttaattgaccatacatgtttggatttacttctgtgcaccctattctgtttcactggtctatggcctgttattccaatatggtatgggtttattccaatacagtatgagtttgattattatagctttgcaatataatttaagatcagaaagtgtgataccttcaactatttgtcagaattgttttgattattcaggatgctttgtcgttccatatgaatttctgaactttaaaaaaaatttctgtgacaaatgttattgggattttgatagggattgcattgaatctgtatattgctttggttaacagacaatttaaaaacattaattattgtattcatgggcatgggatatctttgtatttattcttcctcaacttctttcatcaatgttttacagtttttagtgtctagatcttttacctccttggttaaatttctaagtgctttattttcttttgatgctactgtaaatgggactgttttcttgatttttctttcagctaggttattattctgtgagtaaaaacactactgatttttgtatgttgattttgaatcctgcaactttactgaattcacttattagttctaactgttttttttccctgtggaatctttgggattttatacatataggattgtacaatctgcaaaatagagatactttttctttcctttctaattgccttttatttcttttgtgtgtgcgtgtttgattgctcttgctaacttccagtactatgctgactagaagtggagagttgtcatccttgccttgtactggaccttggtggaaaagctttcagtttttctctgttgattatgttgttagctgtggggtttgcatacaaaatctttattatgtgtgagaaactttccttctaaatctaagctgttgagagttttttatcaacaaaggatgttggacttcgttaaatgctttttccttgtcaattcagaggatcagatggtttttactatttcattctgttaatgtagtatattatattgattgatttgcatatgttaaatcagtgttatatgccagaaataaatctcacttggtcatgatgtacagtctttttggtgtgttgttgaattcggtttgataatatttaattgagaattttttgcattaattctcatcagagaaattgacctatagttttcttttcttgtgatgtctttgtctggattaggtatcaagatgatgcttgcctcataaagtatgtttgggagtatttcctgtagccctattttttggaagagtttaggaagtattggtattagttcctctttgaatgtttggtagaattcagctgcgaaggcatctggtcttgggctcttaatttgggggagggttttgattatttcttcaatctctttgttattattctgttcaagctttctatttctttctgatttaactgtggtaggctttacttttctaggagttaatccaactcttaagtcatccaatttgtttggcatataattgttcataatagtcctgtgtgattcttttaatttttgaggcatccgtgtaatatcttcaatatcattttttattttatttgagtcttttctctcttttttgctagctagactagtaagtgtttttaaattttgtttactttttaaaaaaccaactcagttttaccaatttttttctatggtttttctgttctccatttcatttatttctattctgatctttattgtttccttccttctgctaactttgggcttagtttgttcttctttttctagttcttgaagaatatttttagactatttatttgggatcttttttcctttttaatgtaggtacttattgctgtacactttcctctcagaactgctgctgctgcatcccataggttttagtatgtttcatttccattgtcattggtctcaaggtatttacagtttcccttttaatttctccttttactcattgattgcttaggagcatgttgtttaatttccacatatgtgtgagtttttcaagatatcttctgttattgattcctggtttcacaccattttggtctgaaacaatcttcgatatgattttagttttttaaaatttgttaagggttgttttgtggcctaacatacagtgtatcctggagaatattccatgtgtacttgagaaaaatgtgtattctgctgctgttgcatggaatgttctgtatatgtctgttagggctgtatggtctaaagtgaaattcaagtccagtatttccctattaattttctgtgtagttgatctattcatggttgaaaatgaggtatcaaaatggtctactattattgtattgctgtgtatttctttcttcatgtccattaatatttgctttatgtgtttaggtactctgatgttgggtgcatatatattgataattgttatgtcctcttgatgaattgatccccttatcattaaataatgactttttttgtctcttgtgacagattttgatttgaagtatatttaattagatataagtttcagccacccctgctctcttttggttaccatttgcatggaatatcttcttctatcctcttactttcagtctatgtttgtccttaaacctaaactgggtctgtcgtaggaagcatatagttggatcttatttttttaattcacaaagccactctatgtcttttggttggagtatttaatcaacttacatttaaggttattatttacaagtaaaaccttactactgccattttgttatttgatttctggttgtcctgtggatcctttgctttttttgtctatctttgtgatttgaggattttctgtaatgctaagctttgattctttctctttattgtttgtataccagttataggttttggctttgtggttaccatgaggcttgcataaaacttcttatagttagaattgactattttaaacagacaacaacttaaattctgtcacatataaaaactctagacttttaccctaccccacacaatttatgtttttgatttcacaacttacatatttttatattttgtattccttaaccacttatggtagctttcgttatttttgactgttttgacttttaaccttcatactagagatatgaatgattcacatagcaccattatagtgttggagtattctgaatttgagtatgtgtttgcctgtactcatacatatgaaagaataaaagtactagtgagttttatactactactcctcactagttttatacttttctaggtattcattatagcaattattgtccttttttttctgcttgaagaactcctttaagcatttgtcataaggcagggatagtggtgatgagttccctcagcttttcattgtctgtgaaagactttatttctccttcatttcttaaggacagctttgctagatttagtatttatggctagcttggttttttcttttggtactttaaatatattacccctttctttcttggcttacaaggtttttgctgagaaatccactaatagtctaatgagaatgctgttatacatggcacgatgcttttctcttgctaccttttaaattctctatgtccttggggtgtcacttcaccagccagaaacctctgtggtcagcagtgtcctctgcctgagtattgcttgtgtctgctgggctcgttctgcccactcagcccagcaggctgtgctcagcttatgctaccagcctgtaacctatacctgccaagggcgagccaggcgcagagtggtgaggggtgtgtgggtgagcaagtgcaggatctggtcattgtgcacagccaggcatgctggctgctttggcagcacaggcagctccaggtgccagcacaggtgctggctccctgcaaggctgcagctggaccagatgtaccacatgtggcttctgctgtgggtgcccacatctggacgagagggacatggtggtgcccagaagcttggagatgccaggaaccacacagacccaaagagggtgccacagccctggctctgggagcccctaggtctgagctccccgaagggccacagctcttctctccttcttgtcatccggaatgtggcaagcagaggggcatgtttcagccctgtttgtgttacagcactttcagtcctgccattcagtgggtccaagttcttgtcccacatccaggaaaaatgaggtatgtggacaactggcaggtaagcaaggtgaagactagcttcactgaatgacagaacagctctcaagagacctaaagtgggtagctcctttctgcaggcaggtcatgcacatgaatatctagctctcagtagagaggagacccacagtgggtagctactttccataggcaggtcatcctgatgtctgttcaagtttgagtgtgtctggggtttttatgggctcagaagggaagaaatgcctgctgactggtccatgggcagccacgggcaggcctggaaaaagcgccgtaagttctcattccagtccacagactctacctggaactgatagcctggcccccatgcttcaggccatctgggatttgaaggaggggcttcaccagggaacagcccctttctgcccagaagcctgtatgcctcctgccaccaatcatgttgtccatggtgcccatgctgtttgtgctgaagggcacctgcaggcccatgcctgagctgccgtcagcacctccttggcctcccacttgtgctggtcagggcccaaagtttggaggaggccaaggcggcagggggctaacatgtcagcaccaccccaagcacatgcacacctgaacaggtcacaacagccctgggctcgaccacgactttgctccaccccagagtgggcactgggagcaggcacttccaagcctgcagggacagaggggcttcctaggctgggttggtagctgtggttgggtggctgcaggactcttgccccaacaactcagaagggggcagggctcccacctgttaccagcccccaccagctccatgagcatgcagcccgagccgcacctcccccactgcagctggtctcttagcggccctggctcaagacacgctgcagctgccatcatttacttttgacagcttgattataatgtaccccagagaggacctctttggttctgtttggataactttaagcttcatgaatctagacattaatatctttctcaagacatgggtaattttcagcaattatttcattaaataagctttctgtccctgttttgtctcttttcttgaaaattccatgttgcaagcatttgtttgcttagtagtgttacataagtccaacaggctttcttcattctttttcactttcatttttttcctctgattgattcatttcaaacagcctatcttcaagttcacagaatctttcttctgcttgatctagtctgctgttgaagctcttgattgtatttttcatttcattgatcaaattctttaattctaagatttatgtgtggttttaaaaaaaatgatatctatctctttattgaatttctcattcagatcataaactgttttcctgatttcattgaattatctatctgtattcttttgtatcttcctggatttcctttaaatcattattttgaattcttttttaggcagttggtaaattttcattttcttggagtcagttactgaagaattgttgtgttcctttgatggtatcatatttccttcgttttttgtgtttcttgtatcctgcattgacgtttgtgcatctggtggagcagtcacctctctcaaactttacacagtggcttttgttgggaaagattttcacccacagatgggcttgagggagacaattgggcagggcgtgatgggtctggtcccaggtgggtgtagttatgtaattctccatgtagcttctttacctgtgatgaacatcagcaatgactgtgggtgcctcagtggtctaggctgcaagattttgtggcaacagtggtggcagcatatgttattaggattcttggtggcaagagctttagagattctcctgtacttttcttctccaccacttagctgaagtgtcttagctgaaggaatctctcttcgtttcaagcctgacatggcccacaggtaatggtgctgggatccagggcccaggtgctctgagtgtctgtagagccagagtcctgggctgggctcagggtcttgcaaaactactataggacctgggacttgaggttcagttcactctctgaggcacaagtggctttagttctctaataaagctggggtctgttgctctgaggcatatcctagcagctgaggcccatggagctaggttgtagctatgactgtggtcctggtggtcagggcatagtactgacttggctctgggaagaaggggtactctgagggtttggccctggggagcaaggcacaactgcagttcaggtcccagaaccaataggaaacagtgacaacttgggccctgagggatgagataccacacagtagtgactctggattctgagaatgtgaggcatgacagtaacccaggctctgtgaggccagttgttgcagcagcaatgacccaggaatggcccagctgtggcttaggccctgaggaccggggagtagacagtgatgactctattccccatggagtgggcatgcctcagcagcttggactctgggggactactccagttttagggaggcagggcctttagctgtggagcctaaaaggtggggtagaacagctcagccaagggtaagtttccctggaatatgaggtgccacatcagctcagctccagagtatggctacacacattgccaggggctctagttctctgaggggtggggtgcagcattggcttgggcactgggggcgcaagactgctctgtagggctgaagcttagggtccatagaaagcagggcactacctcagctatggtacttggagatgcaactgccagaggtttgagatcccagagcagtgaggaagagtgttagctcagaccctgagggcagggtgctccagtgactgaaatcggggggatggagtgtctccacagtagcttagctcaggggtaggttgtagtaacagcttgacttagagatggtaatgctatcatgtgggcatggtacagtggcagcaaagactcagggatggagaggtgcaatggctactcatccctggagcagaacacagtctggcagtggccctaattccaagacggtgtagaacagcagcagctcagaccacaaggagagagatacaacatcagctctttctctggggtagtgcagtgtgtagacactggggagctcccttaactaggatcagaatctgtgaggactgtgggagtctccaataatgaagaatgcagatgtccacagtggtgatgggggtttcaggagtcctcttgcttacctttccctgcagagagaaagtctctcctggttatgagctgatccttactgggcgaccagttggtggaggcaaactgtttccttcccttctctacgtagccatactggatttctgtgcttcacaggatttctgttgctccttttctcttctctagtgttctcctttagttattttggttgaaatgtagttgtatattcattgttttgtttttgtgtgtgttgcaaggcaacgagttctacgaacttctagttgaccatcttgctgaaatcacccctaattttacccattttaaaagtgcaattcaatagcattaattacatttgcaatatggtacaaccatcatcactatttccaaaaccattttcatccttccaaatggaaactctgtaaccataaacaataactccttcttccttcacccctcagcctctagtaatctctaatatactttctgtctccatacatttgaccattttaggtatttcatattagtggaatcatacaatatacgtgctcttgtgtctagcttattttactaagtatgatgttttctctccctccctcccttccttcctccctccctccctttctctctctctctctctctctctttctttctttctctctttcaatggagttttgctcttgttgcccaggctggaatgcaatggcatggtcttggctcacagcaacctctacctcctgagttcaagtgattctcctgcctcagcctcccaagtagcttggattacaggtccgcaccaccatgcctggctaatttttgtagttttagtagaggcggggtttcaccatgttggccaagctggtcttaaactcccgacctcaggttatctgcttgcctcggcctcccaaaatgctgggattacagatgtgagccactgcgcccggccctgatgttttcaagtcttaaccatgtatagcatatataagaacttcattcattttaaagctgaatagtattccatttgtatgtatatatcacattttgtttacccattcatctgttgatggatacatgggtagtctctgactttgagctattatgaactatgctgtgatgaacactggcattccagtatctgtttgagtcctgctttcaattcctttgggtattgagattgctagtagtggaattgctggttcatatagtaatcctatgtttagcttcttgaggaactggcaaattgtttttcacaggagctgcaccattttatatttatgccaatgacacacaagagttccaatttctccatatccttgctaacatatgttattttccatttttaaaattatagccatcctagtatctgtgaagtgatatctcattgtgcctctttaattttcatttccctagtggttagtgatgttgagtatcttatcgcatccttattgactatgagtatatcttctttggagaaatatttattcaagtcctttaactactttttagttgtgttgtctttctattgttgagttctaagaattctttttctattcttgatattgaacccttatgagttatatgacttgcaaatattctttttaccatcctgtaagttgcctttttactctgttgacagtgttctttgatgcacaaaagtttttaattttgaagaagcccaatttgtctatttttcccttttgttaattgtgcttttggtgtaatatctagaaatttattgccaaatccaaggtgttgaagatcatgtctattctttcctgtaagagttttatggtttagctctcataattaggccattgatcccttatgagttaatttttgtatacttttgtatgtaatatgaactagggattcaactttattcttttgaaccacctattaaagagaatattctttccacattacatagactttgcacccttgtcaaatgtcttttttttcaaactctcaattttattctagtgctcttatgtctatcctcatgctagcaccacactattttgcttactttcttgttcattttgggttgctataacagaatacctgaggctgggtaacttactttaaaaaaaggtgtatttggctcatgattctggtggctgaaaaggccaacattaaacagttacatttgatgaggacttcatactgcttccatccatgacagaaagcagaagcggagtacgtgcaaaaagaacatggcaagagaggaatcaagaaagggaaaccaaggaagccaggctctttttaacagcatgctctagcaggaactaatccaatcctgtgacagcaagaactcacctctgatggaagacattaatctatttatgagggatctgctccctatgactcaaatacctcccactaggccccacctcccaacactgccacactggggatcaaatttcaacatgagttttggtgggaacagacccctttcaaaccaattactaaggcttggtagtaagttttaaaactgggaagtgtgagtcttctaacttcattatatttctcagtgtgcctttggctattcagggtcccttgaaattccatatgaagtaaagattggcttgtccctttctagaaaaaaaggtcatcagaatcttgatggggattgcattcaatttgtagatctttttgggtagtattgacagcttgatactattaagtcttctttttaatgggatgtctttccattaattttggtcctaatttctttcagcaacgttttataattttcagtatacaagtctttcaccttcttagttaatttattcctaggtatgttattaccttagatgctattgtaaatgaaattgctttcttaatttccttttctagttattcattgctggtatatagaaacacaactgatttttggtattgacattgcaccttgaaactttgtggaattaatttattagctttcttgtgtattctttggaattttctataagtaagacaatgccatttgcaaataaatatattttacctgctccttttcgttatttttttttattgtctaattgctctggctaaaacttaactatacaatgttgcacagcagggtgaaagtgaacttccttgtctcattcctgatcttagaatgaagaattttagttttttgccatagagtataatgttagctgcgggtttttcgtaaatgctctttagcatatgagaaatttccctcctctacctagttttctgagagttatttttatcataaaaaagatattggattgtcaaatgccttttctgcattacattttggtaattatgtgggtttcccccttctttctattaatgtgatgtattacatttactgcttttcttatgttgagccacccttgtattcctgatataaatcccacttggttgtggagtataatttttttaatgtgccattcaatttagtttgctaggattttgttgaggatttttgcatttctattcataagggacgttggtctgaagtttcttttttcttgtgatgtttttatctgactttgatatcagggtaatgctgaccttatagaattagttacaaagtttcctctcctcttctattttttaaaaacagttcaaggtttggtattagttctttgaatgtttggtagaatttatcagtaaagccgtctggtcctggatttttctttgttgagacatttttgattattgaattaatctcttcacttgttatataggtctgttgagattttctgtttatttttaagtcagtttaggtaatttgtgtatttctaaaagtttgtccatttcacctagattatctaattttctgcatacaattgttcatactattctcctaaaatcctttttatttctgtatagtcaatagtaatgtcttcacttttatttatggctttagtcatttgtatcttttctcttttgttctttattagtctagctaaattttgttaattttgttgatcatttcaaagaacaaacttttgggttaattcactttctttattgtttttgtattctctattttatttatctgctatctaacctttattcttttcttccttatcttacctttgaatttaatttgctctttttctcccatttcctcaagatataaagttaggctactgatgtgagatcttccttctttttaatgttggcatttacagctacaaatttccctctgaactctgtctttcatgcatcccataagttttggtatactagtttggttttcattttcattagtctccaatcatctaatatcttttgtgatttctttttgacccattggttatataagaatgcattgcttaatttccatatatttgtgaattttccaattttcacaggcattgatttctggcttcattctattatagttggagaagatgctttgtataatttcaattttaaaattcattgatatttgctttgtggcctacctaacacatgatttatcttggagaatattccatgtgcacttaagaagaatgtgtatccttctattgttgggtggagggttttgtgtatgtatgttaggtctagttagtttatagtgttgttcaagccctctgtgcccttatagatcttatggttaaatgttctgttcattattgaaagtggagtattgaagtcttcaattattattgtagaactgtatatttctcccttcaattttgtaaatcctaaagatctcttgactctggcttcctggctaccaaatttttttctgttctactttaatggtacctaaccagcttcagctttgttctgattaaatctgttccccaaacagtaaccaaggtaactttttctgaaaaccaaatttcatcccaacacttctcactctaaaaccattttcctagctctccattagcctcaagaaaacgttcttttttcttagcatgatttcaaagcccaccatgacctggctttggttcctacctttaattttaccttctttccactcttccttcttactcctgattccaaatatattgagtattgcatgtttccaattgcacccaatcctttcaccccctggcctttgttttactttgtatgctgctagaactgcctctagttctgctcctctatctcttcatatacagaatttctattgatctataagtgtcagttaaatcatcagttcctctgagaaacatactctgacttccttatacaaaatcacatatccttttaaagaattatacccttccatgtgttttgattcttatcataactcttaacataccacattttggcttgttaatcaccactagggcctctagcattgtgcctggcagataatagcttcactgggaaaggcaagccacaattggccctcaatatctcttcatgatcttgctgagtatgccaagaatacaagatcctgatcactctttatctggacccattcctcaggattgtatttgcagagagcacacctgagagataatgaagtaatgtctctcagacaaaaagcaggactctttctacttagcatattagtgatgactcatctaagatgtgtgggttcttgtcttgtaacacaaccactgtacacatgggcattcatcatggactgtttaaattggccctgcgggattcagggaaaacaggatatccacgcacatgacctgctgttgccatgagtaaggaagtcctttgtctctgacccaggaatctcatgtcttctgctagcatctgagaaacagtaatagtctaaattgttagcttgcaagtagagtaaaatcctagacccctcacaattcttgaaagttcaagaagtattttttagctatgtaaaccaaaaataaaatttgaagcccctcaaccatctgaatggaagcctcctcttgactaagggcattccaaagttaacctggaaaactagtttaggctgtgatgggaagggttgtttgggcatacctcattacaccctcctcccttttggaattcaggaaaagctgaccagcattaacatcaacacagatcttaagtctgataaaaacaccaaaacaatatttaaaatctattctctcagaagcctgctaccaggaagcttcatctgcataataaaactttagtctccacaacacctgtcatcatagcccagacctttctttctattgattccagaccttttgataataacttaactctttcaaccaattgccaatcagaaaaattttaaatctatctataacctggaagcccccattttcagttgtcctacatttccagatcaaatcaatgcacctcttacaggtattgaatgatgtattatgtctcctaaaaggtacaaaagcaagctaggccaggtgcggtggctcacgcctgtaatccctgcactttgggaggctgaggtgggcagatcacctgaggtcaggagttcgagaccagcctggctaacatggtgaaaccccgtttttactaaaaatacaaaataaaaactaaaaattagccaggtgtggtggcgtacacctgtaatcccagctactcaggaggctgaggcaggagaatcacttgaactcgggaggcggaggttgcagtgagccgagatcacaccactgcactccagcctgggcaacaagagtgaaactctgtctcaaaaaaaaaaaaaaaaaaaaagcaagctgtacctcaaccaccttgggcacatgttgtcaggacctcctgaggctgtgtcatagatatattcttaacattggcaaaataaactttctaaattaattgaggcctgtctcagagacttttgggttcacggctgtaagaacaaaagctggaattgtcacctgcactaattttctagggctgtgataacacagtatcacagactgggtggcttgtacaacagaaatttactttctcacaattctgagggctacacatctgaggtcaatgtgtcagcaggtttggttctttctgagagctgtgaaggaaagatctgtttcaggcttctctctttggcttgttgatggtcatcttcttcctgtggcttcacatggtttttcctctgtacatgtttgtatctgaatatcctcttcttataggaagctagacatattagattagggcccacactaatgacctcattataacttaattacctctgaaaagactctatccccaagtctggtcacattctgaggtactggcgtttaggactccaacatagaaatttttggagggacacaattcagcccataatagcatcataaataaaagcagaatacaaacatttggtaggttttacctcataagcctttgtcttattaaatgtaatgaattattaacaaaaatatttaaaaactaactttatttcggagagacataaacttgattttttcccaacatatttcaaaaattcttcttaaatccttgctatttagcatttttctcctgtgggtatactaataaaactatttgaccattcgagactgtattttaaagcagagacatttccaacattacactaaggcaatcatttattatacagattagtctaaaattttctctgaaattaaaacatgggaatagggtgcatttgtattggtaggtgttatctaattatgaaaactgatagaattaaaacattaaaaatagccacaaaatgagggcaagtcttactgacttgagatttatctttttagcttatagtatctcatttctggttttgtgtgtcatgtggaattaaacattagtttttgacatggaaaagaaatttcaagagattaaggcttgagaaatacaattaaagaacatcacaactaaggtcaggcacagtggctcatgcctgtagtcccagcactttgggaggctgaggcgggggatcacttgaggtcaggagtttgagaccagtctggccaacagggtgaaacatcatctctactaaaaatacaaaaattagctgggcatgggtggcgcatgcctgtagtcccagctactcaggtggctgaggcaggagaatcgcttgaacccgggaagtggaggttgcagcgagccaagatggcaccactacactccagtctgggagacagagtgagactctgtctcaaaaaaaaaaaaaaaaagaatatcacaagtaaaattacccatgatttgtgttccctaagcacaagcaaacaaggcaattggaatagaaaaattatttctattccatggaaatcaactttctgggaggctttttatcccaacaatatttgcctttttgtatttacaaaacaccgaatttttgactctgaaaaaaaaaatgctacagtaaaaccacaaagtcttgattacctatgaaattcatacatttccttagaaattgggccataattcaattaccccaaagtgattgtcaatttttactttttaaaaaactgtcagctgggcacagtggctcatgcctgtaatcccagcactttgggaggctgaggcaggtggattgcctgaggtcaggagtttgagcccagcctggccaacatggtgaaaccccgtctccactaaaaataaaaaaattagcagcttgtggtggcacgtgcctgtaatcccagctactggggaggctgaggtaggagaatggcttaaacccaggagacagaggttgcagtgagccgagattgtgccactgcactccagcctgggagacagagtaagactccatctcaaaacaaaacgaaacaaaacaaaacctctcataagaaactttagaagttttctcaataactggaactcatttttctaatgaattccatcatttaaaaatatttattaaatgtctactatgtgttaaatgttacagtaattgctagggacatcatggtgaacacagtctgcatgctctttgcctccagttattttgtacagtattttggctttatctaatgttttcttatgaaatgaggggtttgtgataggactatgagttatacgaatatgagggtgatgttccctttgatcatttgggtaaggtagtatctgttgagtttctccactgtttaggtctttttgtaagtaataaacatcttgagggagatatttgagactatgtgaatatattgcttttcctcaaacttttgctcaccaattttagcacccatccatggatctttctatggcaagttttgctgtggtgtttgactgatgttgagtttctatttccctctttccttctgcatttattacttgtagttattctgtaaggaaatgctgtcccatctccccattttatttgtttatttatttatttatttacatcacttgtggcttaatgatgtttattttattctatttaatactatcattctgtattttgtggcctaaattgttccagctttgatgtccttttgataagctctaacttaaaaattctttttaaatctttttttggatttattccaaacccttcatctacccagggctgttttattttacaagcattctttggccttattaaaacattgatagttgacaaaaaggtttattgatgtgtaattgaataattggtacatgataaacttcgcatatttgaagggtacaatccggcacattttgacatacttatagacctgtgacaccatcaccacattcaagttaacccatttatgcctaatatcccattattggaacgctatgcacgtgggagttatttatatcctactgctcaaggtcatagccaaggtctgattgcaaaaattttaaaaattgcaacctccagcataagtgggttaatgaacatgtatatcacccctaaaactctcctcatgcctcccccttaccctcacccaatattctgaggcaactgctgatttgttttctgtcattggagattaattcacactgtctaaaatttcatgtaagggaaaccacacaactttcctacttgtttctttcattagtataattattttgagatccattcatggtgttgtatatatcaatcgtttattcctttttattgttgaatattattccactgtatggatatacatgtatccattgatggacatagggttcattccctgctttgggctattacaaattgttccagcactttcaacatgtgtttgcgtgtcttaggagtcgaatgattggatcagtcacattgtaggttaatggttaatttttttagaaacttgccaaacagctttccagggtggttataccattttctattcctatcagaagaataggaaagttccagttctttcctatcctttccaacacttggtatggtcagtctttcgaattttatctactttaatagctatattatggtatcttattgaagtctttatttgataaatattttaaacacctttcccatgctcttagtagccattcttatctcatctttcctgaagtgttgacacaatttttttattggattgcttgttttctcaatattacatttttagagtttttcattctggatgactttatcagattgacggtttgcaatattttttctcagtgtatggctagcttttcattttcttggcaatgcttttaaagggaagaaagtctgaattttgataaagtctaattcattaactttttctgaattaattttactttttgcattatatctaaaaaatctttgcctatcacatgatgacaaggttttctcctctactttcttataggtattttatagtttaggttttacatttaggtctgtgatccattttgaattaacattttatatggtgtgaggaatgcattaaattcctttttggttcacttttttgggtttttgtattgttttgttttgtttgcatatggatatccaagtgtcccagcactgtttgttgaaaaaactatattttaatctactgaattacctttgcacttttattaaaagatatgtgtgtggttctatttctggactctttattctcttttattgatttatgtgtctatcttgacactaatgtctcactatcttgatcactgtacctttacaataatgcttaaaataagatagtgctactatccaaatttatcattctttttaaaagttctcttggtgttccaatcttttgaattttaacattttttaaggatcagtttgtcagtttttgtcaaaaaaaaactttctggaatttttattgtgatctcattgaatttatagatcaattaggagagatttgccattttaataatattgattcttccaagctgtaaacacttgttatctctgcatttaacactgttatcgctgttatttatttatttcttctgcactttctctcagcaatatcttatagttttcagtgtagaggtcacatctttgtcagattcattcccaagtgttttttatgctattataaacagtgtttaaagttcaatttctcattgttcattgttaccatatagaaatataatgtattatattatattagttctggtagctgtgtagcacatttcattggattttcttcatagatagctttctgtttgcaaatagagacagttttacttcttcctttccaatttgaatgtcttttatgtctttcatcaccttattacactgctcagaacctctagtacaatgttgaaaacaggtggagtgaaatctttgtgttgttaatttgggggaaaatatttaatcttttactgctaagtatgttagctataggtttattgtaggtactctttttaagtttgagcaacttttattccaagttttttgcaagattttaagatgaaaaatgtaaatatgattttgtgaaatgtttttttctctgtcttgagatgatcatacagtttttttcttttcatttgttcatgtggtagattgcattgattttcaaatgcaagccaaccttgtattcatgggataaaccccactttgccatgttatattgttctttttatatatcagtgacttagatttatttagaatttttacatatatttttatgtggaattttaatctgtaattaaaaaaatacatttgttagtttttttgaatcaataatgctgtccttgtagagagaatttggaactgttctctctaattttctggaagagtttttatagaattagtattattattttcttaaatatttggtagaactcaccagtgaagttattttatcctggagttttctttgctgggaggattttaactaaaaattcaatttcattatgagattcagggctatttaggttatttatcttcttcagtgagctttggtagtttatgtctttaaaggagtttgtccatttttgtctaaattgtcagatttattggcataatattattcatagtattctcctgttttgcttttaacatttgtagcatttgtagtaatgtcacctctctccttcttgatattgggccttcatttcttctatcttttttttctgataagcttttctagaagttatccattttttttatcatctcaaagaaccagcttttggttttattgattctattttttctgttttctatttcactgactttaatgttaaaaattcttatatatttacctacctagttaccatttctggtgatacttaatattttagttaactttttcttaatttaatgttgttctatcaaagtcattagaaagtatttgcttatttgggagtccaaggcaggaggactgcttgaggcctggaattttgaagtgatctcattgctggaggtatcacctgaagttcttggtgtcaagaaaattaaggagcatggacaccaaggatgaggttggggcaaagtttaataagtgaaagaagaaagctctctgctgtggagagggatgccattttgcagttgaatacaataatttttagaaacaggctggtgggacaggatgccttatttgcataaggtgcgaaaaactggtcaggactaagtgtttcgtttgcataaggtgtgaattcctgacagttccaccctgtccctctagtgcccatgtgggctgttagtctgagttactccatgttatttaacttccctactgcccatgtgtcaggggatggaattttccattgtggacctgcctggttctgtgtatcttatctgtgcagctataggcatgttttaggcaagactccctatgcaagctcccttaattgagtatgcccaaaaaaggaaagggatgtgctcagtgaagcccatcatgtatatgtgaatcttgctggctacacaaaaggcagtttttatgttggatcttgcttccttatctgtgcttgtagcttgatctttcaggctgctcttttagaaaagaactcttccaaggacatgtcctaagtctctgcttaacttgttccttcctctctcctctctcagtttgagatcagcctgggcaacatagtgagaccctgtctcaacaacaataacaaaattaaataaaaaattagctgagcatggtggtgtgcaccatagtcctagctactcaggaagctgaggcaggaggattgcttgagcccaggagttcaaggctgcagtgaactataatcatacctctgcactctagcctgggtgacagagagagactctgtcttaaaacaaaaaacaaacaaataaataaaaaagaaaatatttgtttatgtatttactttctccactagactataaaatccttgatgcgggtactgatttttattaatatttgcatttcaaatgctatagctcgaatacagtgctcaatgaatgtatgtataatgaatgaaggaatggatggatggatgaatgggggtaatgagacataccgtagagtcttttccttaggcaaaggcacactgacaaagagccctttttatataccctcttcatccagaatctggggaagatattgatgaggatggtggagaaggtagagagattggggttttatacgttcctttgttcataaaacatgttagaaaaataatgtctgagttgagctcccttctccccagcaacctctctccccagccacccccaccatccactgctccttctgccttgagtagagtcagaggagaaggctgtgcaggtagtttgagaagcaatcctcggaggaagagtgagggaccaggggagtgagacagggaaaaaagaagaaagaaaagtgtacagattgctgccatgggcaaggagggcttggttctttttttttttttttttttttgagatggagtctcactctgtcacccaggctgtagtgcagtggtgcaatcttggctcactgcaacctccatctcccaggttcaaatgattctcctgcctcagcctcccaagtagctgggactataggtgtgcaccatcatgcctggctaatttttctattgttttagtagagatggggtttcacaatgttggccaggctggtcttgaactcctgacctcaagtgatctgcccacctcagcctcccaaagtgctgggattacgggtgtgagccaccacgcccagcttggggtttgttcttaatagacaacttgtgaaaccagaattgtccacctgaaagacaggagatggaatgtttatccaccaaatcacattctttatttttcaagggttttccctgggggagttctgcaaagttcctgagttatgcacatttagagcctagcaagcatacacctgagtctttagttattaaatagagaagtcaaaaatgaacatctggctcataatgcatggcatatggggtaagtgcattgggcaccctctgaaaggcattacaactcaaaagtactattttacttatgtcttgaaaactgcaaaaatgcctaatatatcctaagcatataggcaatatagaaaggtttagaatagaaattaaatgctacattgccatctagttccttctgtgtaacttcataagcaatgagtaagacgcttttgtcattttcattgggaacatctgaattccatgctgtctatgccatgtttggagtttctcatctatcttgggtggaaacttgttcctggtcattgattttggaaagatttactcagtcagggacgattatggtgaagaacttgttaagctaccttgtttgtagagccaaccaaccccatcttatttatcttgtcaattccacagtttcacattttccaatttatacacagaagaaaatacatcccttaggaaaatgcccttaggaaaacttaacctagtttgacttcttaaaatttttttaactaaaaaataaattcaggtaaaaatttgaaaagttacaaataaaaagcaaaaataacaagttgtgtgtgtatgtggggtaaggattgagttgataactaaaaaccaaaagggacctatgttagttttctgagggtgccatgacaaattgccacaaacttcgtggcttaaaacaacagaaatgtattcactcctagatctggaggtcagaagtctgaaagccaggtgttgcccacactccctccggaggctcttgggaagaccttgccttgcctcttccagcttctgatggcttcaggtgtttcttggctttcttggcttatggccgcgtctctccaatctctgcctccagcttcacattgtcttctcctctgtgtctgagtcctctctgctcctgtctcaaatcagctctgcttttctgttattattaggacacttgcattggatttagggcccacacagataacctaggatgatttcctcatcgcaatgtccttaataactcttaaggatgaacctcaggtaaggagaggaaaaggaacctagaggaaaggcatcttatttaggaaacaaagtgacacacatctataaaatatattggcaagactatagtcttgccaatataggtaggtaatcacggtcattgttctatatgcttaataacgtggatttggaatctagtcaacattaacaaaatggggggaggttattcaatgggtacttaaaacctactaaggtatttgtcttgctgagaaggaccaggtgtgaaataactttagactttgttagttgatagttgagtatatatgttactacaaactacaaaataagaagtaaatccaaatatactagcaatcaatacatttctttatttctttccaatctattatcttttattttttttggtcttaatgcacctgctatgactgtcaatacaatgttaaatagaagtggtgagagtggacatccttgccttattcctgatcttaggaggatctgtgttatcctattaagtataatgttagcgatagtttttttgtaagcgttctttattgagaaagttccctctatttcttgtttgctgagagtttctatcataaatggtgttagattttgtcaaatgctttttctgcatctattaatatgatcatgtgctttttgttagaccgttgatatgatgtattacattgactgattttcagattttgaaccatctttgcatacgtggaataaattccacttgattgtaatgcataatcctttttatgctttgttgaactcaatttgttaatgctttattaagaagttttatatctacattcatgagagatattggtctgtagttttcttttcttataatatctttctctggtttaggtattaagataatgctggcctcattgtataagttagaaagtgccctctgtgcttctattttctggaagagattgtattattttttctttaaatgtttgatagaatttaccattgattccatcaaggcccaatgttttttttgggggtggggggagggaaggaaatagttattattattcaatttgcttaatggacataaaatattcagtttatctatttttttgtataagttttggtagtttatgtctttcaaggaattgatccatttcatctcagttattaaatctgtggccacagaattgtttgaaatattctttattatccttttaatatctatagaattagtataatgacatcttatttataatattggtaatttatgtcttctacatttttatcttggttaacctgtgtaatggtttatcgatcttattgatattttcaaagaaccagcttttggttttgttgatatcctacatagtttcttattttcaatttcattgatttcttttctgatttttattatttcttttattcagtttgctctaggcttaaattgttcttctttccgtagtttcataaggtggaagcttaggttattgattttagatatttcttctttgccaacatgcacatttcatgctataaacttccttctaacttctacttttgctgcattccacaactgttgataggttgtaattttatttatttcattatttattattttattaaataagatatttatttattaaatattttatcttgagacttctttgacaaatgtaatatatagaagaatgttgtttaatttccaaatatccagggattatccagctatctttatgttatggtttactagtttagttccattgcagtctaagaatggcccggcacatgacctgtcttggtgaatgttccatgtgagtttgaaaagaatgtgcattctgctgctgttgggcgaagacttttataaagataaattagagctagttgattggtagtgacactcaggttgtctatatcctttctgattttctgtcagctccatctatcaactaccaacagagtgttgaagtctgcagcgataatagtggatatgtccatttcttcttttaattctatcaagttttgcctcatgcattttgatgctctattgttagatacatatacatttaaaattgttctgttgttttggagaatcgactcctttataattatgtaatgtccctctttatccctgataattctgtctgctttgttgaaaaatagaactgttccagctttcttttgattagtgttaatatggtatatcattccccatcctttacttttaacatatttgcatctttatattttatgtgggtttcttgtagacaacatatagttttctttttattaaccctcaccaaaaatttctgtctttttattggtgtacttagaccatgcatgtttaaagtcattattggtatagttggttaatacctaccatatttattttatatttgctgtatttttttctttgtttctcacctccctcacatgtttctgccctctcaggttttaactgagcattttatattattccattttctctcctatcttggcatatcaaatatacctctgaaaaaaatttttttagtggttgtcctagagttaacacaatatattttaaactaacttaactctaccttcaaataacactatactacttcatgggtagtgcaggtgccttataatggagtattcctatttgcttcctcccttcccttgtgacattgctgtcattcatttcatttatacatatgccataatagccccatacaatgttattattgttactttaaacagttatcttttgtatcaattaagaataataaatataaaatgttttattttgccttcattcattccctctctgatgcagctccactctttatgcagacccaagattttgacctatgttatttccttctgcctgaagagcttataaaatttttggcagggccaatttgctggtgataaattttctgtttgtgtttgtcttagggagtctttatctctgtttcaactttgaagggtaatttttctgcatataaaagtctaggttggtgtgaactttttttcttttgacactttgagtaatttactactccaattctggcttgcatggattctgatgagaagattcttctcttccaaaaactaatctctatctttgctctcttagcgttaagctgtatttttcctctgtcttctttaatgattttctttttgttttggttttcttagttgcaataggctattcctagatatattggtatttattggtattactcctatttgtctttggttttctaagttgcaataggatgttactaaatgttattctattggtatttatcatgtttggtgttctctgagctctgcatctatagtttggtgtctgtcattacttttggaaagttcttaaccattattacttcaaatatttcttcttctctgtaccttttcttctcttttgatatttcaaatacgtatacactgcccattttgatattgtcccaaagttcttggagattcagttctgttttttaaaaaaaatatttcttctcttcacatttcagtttgtgaagttttaactgacctgtgttaaacctcaatgattctgtctttgttgtattgtgtatactggtgagcccttcaaagggattcttcatttctgccacagtgttttttacttctagaaatttatttagattctttattccagtttcatctccctgcttgtattatccatgtttttttttgcatcttgtctacctttactctatttttcccattagagctcttaacatattaatcatagtcttttaaattctttgcctgacaatttcaccatttgtgtcatagctgagtcagattccagcgtttgctttgtctccttgtagtgtgtgcatttttttttccttttagcatgcctttaaattttttgtggaatgcttgacgtgctatattggttaataggaactgaggtaaataggccatttatgttaggatttatgtgagaatttatgttaatctgttcaggagttgggctgtttaatgtttgctgtgctataggtgccagaggattaaaattcttctaatgtccttgttttctaatctttcctcttcactttaacctttcataagtacttttctttagagagagtctgagtcttgtggttcttttagctggaacccactgttattatactacagccctgtaggcatggtagtaaagggtgtggtgtgtgtgtgtgtgtatgtgtggggtgtgtgtgatgtacagtagatctgtgtgtgtgtgtaagcattctaaagtcacatgtttagatctcagtcttttagttagcctgtgtctttgtgttggctggtgtgattgatcctgattaccaaagggaaattgaaccactaatccacaatagaggtaaggaagagtgtgtttggaatacaggagatatgttaggacatctcttaatattaccatgccctgcaattaaagtcaatggactttacaatgacaacaacccaactccagccagagtactaacaacacagacccttctgaatgaaggttagagtcactctaccaggtgaaaaaccatgaccagctgagatgcttcctgagaacacaagaaatacagaatggtagtggatgaaagtagttataaaaagcagctaagactgtatgacctgttatgtaaaaagagaactgcaattgttatgagcatgagtttgttttgttatggatatgtatgtttgtataatgtctttgttttcttccctctcttatccccttatcatataacatgtaaagtattggctctgtatcatagtatttaagcattgttaattttatttcataatacttaagttgtaagacatcaaggaaaagagtaaacatcacccaagaacgttgcatcctttttgaggaaagggttaatgcacttttggccatacgcaggatagttctatcacattaggcagaagtatgacattgttattgtatttattctgagaataaacatggtttaaagaggtatatacgggtgtcaagttgacaaagagtggacttgtgatggttaatgttatgcgtcaacttgggcaggccatgatactcggatatttagtcaaatactctcctagatatttctctgaaggcattttttaggcgagattcatacttaaattagcagactttgagtacagtagaataccttccacaagtcagttgaagactttaaaagaaaaaagaatgattcccccaatgaagagggaattctgcaaagcagactgcattgagagtcaagctaccttcaacaacaactgttaccttagtctccagcctgccaattctgcagattctggacttgccagcaccccaaattgcatgatccaagttcttaaactaaatatctctctctgtctttatacacatattatatattatattatatcatattatatgtatatacaacttaaatgtgtgtgtgtaaatgcatatgtgtgtgtatatatagcatatgtgtgtatgtatacatgtgtatatgatgtatgtgtgcatgtgtgtatatatacacaaacatacatcttttcagttttgtttctctggaatactctaatagagcatttcttttagaggggtgctaatataaatgatatcacatttttgatgtcaaaatctaattgttcattgttggtatataagaaagcaattgacttttgtatattaaccatgtatactgcagccttgctataatcacttattagttacaacagggttttgtgttgattctctgggattttttttaattattactattatactttgagttctagggtacatgtacataacgtgcaggtttattacatacgtatacatgtgccatgttggtgtgctgcacccattaactcgtcatctacattaggtatttctcttaatgctatccctccccccaacccccaccccacaacaggccctggtatgtgatgttccccgccttgcgcccaagtgttctcattgttcaattcccacctatgagtgagaacatgcggtgtttggttttctgtccttgcgatagtttgctgagaatgatggtttccagcttcatccatgtccctataaaagacatgaactcatccttttttatggctgcatagtattccatggtgtttatgtgccacatttttttaatccagtctatcactgatggacatttgggttggttccaagtctttgctattgtgaatagtgctgcaataaacatatgtgtgcatgtgtctttatagcagcatgatttataatcctttgggtatatacccagtaatgggatggctgggtcaaatggtatttccagttctagatccttgaggaatcaccacactgtcttccacaatgcttgaactagtttacagtcccaccaacagtgtaaaagagttcctatttctccacatcctctccagcacctgttgtttcctgactttctaatgatcgccattctaactggcgtgagatggtatctcattgtggttttgatttgcatttctctgatggccagtgatgatgagcattttttcatgcgtcttttggctgcataaatgtcttcttttgagaaatgtctgttcacatccttcgcccactttttgatggggttgtttgtttttttcttgtaaatttgtttgagttctttgtcaattctggatgttagccctttgtccgatgagtagattgcaaaaattttctcccattctgtaggttgcctgttcactctgatggtagtttctcttgctgtgtagaagctctttactttaattagatcccatttatctattttggcttttgttgccattgctcttggtgttttagtcatgaagtccttgcccatgcctatgtcctgaatggtattgcctaggttttcttctagggtttttatggttttgggtctaacatttaagtctttaatccatcttgaattaatttttgtataaggtgtaaggaaggaatgcagtctcagctttctacatataccaagccagttttcccagcaccatttattaaatagggaatcctttccccatttcttgtttttgtcagatttgccaaagatcagatggttgtagatgtgtgatgttgtttctgaggcctctgttctgttccattggtctttatctctgttttggtaccagtaccatgctgttttggttactgtagccttgtgtagtttgaagtcagccagtgatgtctccagctttgttctttttgcttaggattgtcttggcaatgtgggctcttttttggttccatatgaactttaaagtagttttttccaagtctgtgaagaaagtcattggtagcttgatggggatggcactgaatctataaattaccttgggcagtatggccattttcacgatattgagtcttcctatctgtgagcatggaatgttctatttgtttgtgtcctcttttatttcattgagcagtggttcgtggttcttcttgaagaggtccttcatgtcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggaggttttgggctgagacgatggggctttctaaatatacaatcatgtcatctgcaaacaaggacaatttgacttcctcttttcctaattgaataccctttatttctttctcctgcctgattgccctggccagaacttccaacactatgttgaataggagtggggagagagagcatccctgtcttgtgccagttttcaaagggaatgcttccagtttttgcgcattcagtatgctattggctttgggtttgtcataaatagctcttattattttgagatacatcccatcaatacctaatttattgagagtttttagcatgaagggctgttgaatttagtcaaaggccttttctgcatctattgagataatcatgtggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggattttcacattgatgttcatcagggatattggtgtaaaattctctttttttgtggtgtctctgccaggctttggtatcaggatgatgctggcctcataaaatgagttagggaggattccctctttttctgttgattggaatagtttcagaaggaatagtaccagctcctttttgtacctctggcagaatttggctgtgaatccttctggtcctggactttttttggttggtaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggataggtggtgatatcccctttatcattttttattgtgtctatttgattcttctctattagtcttgctagtggtgtatcaattttgttgatcttttaaaaaaaaccagctcctggattcattgattttttgaagggttttttatgtctctatcttcttcagttctgctctgatcttagttatttcttgccttctgctagcttttgaatttgtttgcccttgcttctctagttttttaattgtgatgttagggtgtcaattttagatctttcctgctttctcttgtggacatttagtgctataaatttccctctacacactgctttaaatgtgtcccagaaattctggtatgttgtgtctttgttctcattggtttcaaagaacatctttatatctgtcttcatttcgttatttacccagtagtcattaaggagcaggttgttcagtttccatgtagttgtgtggttttgagtgagtttctcaatcctgagttctagtttgattgcactgtggtctgagagaaagtttgttgtgatttctgttcttttacatttgctgaggagtgctttacttccaactaagtggtcaattttggagtaagtgtgatgtggtgctgagaagaatgtatatactgttgatttggggtggagggttatgtagatgtctgttaggtctgcttggtacagagctgagttgaagtcctggatatccttgttagccttctgtctcgttgatctgtctaatactgacagtggggtgttaaagtctcccattattattgtgtggaagtctaagtctctttgtcggtctctaaggacttgccttatgaatctgggtgctcctgtgttgggtgcatatatatttaggatagttagctcttctcgttgaattgatccctttaccattatgtaatggccttcttttgatgtttgttggtttaaagtctgttttatcagagactaggattgcaacccctgctttttttttttgttttccatttgtttggtgtatcttcctccatccctttattttgagcctatgtgtgtctctgcacatgagatgggtctcctgaatacagcacactgatgggtcttgactctttatccaatttgccagtctgtgtcttttttttttttttttactttttttaaaattttattattattatactttaagttttagggtacctgtgcacaacgagcaggtttgttacatatgtatacatgtgccatgttggtgtgctgcacccattaactcgtcatttagcattaggtatatctcctaatgctatccctccccccaagtctgtgtcttttaattggagcatttaacccatttacatttaaggttaatattgttatgagtgaatttgatcctgtcattacaatgttagcttgttattttgcgcattagttgatgcagtttcttcctagcatcaatggtctttacaatttggcatgtttttgcagtggctggtaccagttgttcctttccatgtttagtgcttccttcaggagctcttgtaagacaggcctggtggtgacaaaatctctcagcatttgcttgtctgtaacagattttatttctccttcacttatgaagcttagtttggctggatatgaaattctgggttgaaaattcttttctttaagaatgttgaatattggcccccactctcttctgacttggagggtttctgccgagagatcagctgttagtctgatgggcttccctttgtgggtaacccaacctttctctctggctgcccttaacattttttccttcatttcaaccttggtgaatctgacgattatgtgtcttggggttgctcttctcaaggagtatctttgtggtgttctctgtatttcttgaatttgaatgttggcctgcctagctaggttggggaagttctcctggataatatcctgcagagtgttttccaacttggttccattctccccatcactttcaggtacaccaatcagatgtagatttggtcttttcacatagtcccatatttcttggaggctttgttaatttctttttactcttttttctctaaacttctcttctcgcttcatttcattcatttgatctgctatcactgctaccctttcttccacttgattgaatcagctactgaagcttgtgcatgtgtcacgtagttctcatgccatggttttcagctccatcaggtcatttaaggtcttctctatgctgtttattctagttagccattagtctaatcttttttcaaggtttctagcttccttgtgatgggttcaaacatcctcctttagctcagagaagtttattactgaccttctgaagcctacttttgtcagctcatcaaagtcattctccgtccagctttgttccattgctgatgaggagctatgatcctttggaggagaagaggtgctctggtttttagaattttcagcttttctgctctggtttctccccagctttgtggttttatctacctttggtctttgatgatggtgacgtacagatgggattttggtgtgaatgtcctttatgttgatgttgatgctattcctttctatttgctagttttctttctaacagtcaggaccctcagctgcaggtctgttggagttcgctggaggtccactccagaccctgtttgcctgtgtatcaccagcagaggctgcagaacagtaaatattgccacctgatccttcccatggaagctgcatctcagagagtcacccagctatatgaggtgtcagtcagcccctactggcaggcgtctcccagttaggctacacgggggtcaggctacttgaggaggcagtctgtctgttctcagagctcaaactctgtgctgggagaacactgatctcttcagagatgtcagacacagccatttaagtctgcagaagtttctgctgccttttgttcagctatgccctgcccccagaggtgaagtctacaaaggcaggcagtcctcgttgagctgtggtgggctccacccactttgagcttcctagtgcctttgtttacctactcaagcctcagcaatggcagacgcccctcccccagcctaggctgccacctggcagttcaatctcagactgccgcactagcagtgagcaaggctccgtgggcgtgggacccgccgagccaggcatgggatgtaatctcctgttgtgccatttgctaagacagttggaaaagcacactattagggcgggagtgtcccagttttccaggtactgtctgtcacagcttcccttggctaggaaagggaattccccctgactccttgtgcttcctgggtaaggcaacgccctgccctgtgttggctcaccctccgtgggctgcacctactgtccaaccagtcccagtgagatgaaccaggtacctcagttagaaatgtagaaatcacctgtcttctgcatcgattacgctgggagctgcagaccagagctgttcctatttggccatcttggaacaatctccaattctctgagattttctaaatagacaatcatgtcatctgtgaacaaagacagtctatttcttcccttccaatctgtacttttatttccttttcttatcttattgcattagtgagtacttccagaacaatgttgaataggagtggtgagagggatagctttgccttgtttctgaccttagagggaaagcatccagtttctcacccttatgtatcatgttagttgtagggtttttgttttttttttttaatcaagttgacaaaggtcccctttgtccctagtttgctaggagttttcatcatgaatgggtgttggattttgtcaattgctctttttgtacctattaatatgatcttatggtttttcttctttaatgtgttgatatgagggattatgttacttgatttttgaatattgacctgtcttgcacacctgtaatgaattccagttgttcatagtatgtaattctttttatatattatttgatttgattttctaatattttattgaaggctttttcatctaggctaacgagagatattggtgtataatttaggtttttctaccctggcactagttcccatgaaggctgctgctccttggcttctgttccagtatgtggtgattctctatatgcacctttctgtctcttcctattttggggcaatggtttggcctgtaaactcaattctatgatctaataagagttgtttattttccatttatgtctttctcttgtgagggcaggagtgatggcttcttagtgccttatgtgctgggctagactggaaatggttttttattctacctaaattgtggattttcatcctgggaatcctaacactctgaaggggttaggtgaggtggaagaaagatgagataaacgacttgagctttgctagccaaaaggtctctttcctgagtactttaatctgtccttgtcattcaaaagcagccatgggcaatagggaaacaaaccagtgtggctgtttcccaatacaacttcatttacaaaatgggcagtgggccagattagtcagcccctcatgtagacaaagtcctgcctatatattaaatggcagaacaaaaaagtaagaaagaacctggatggccttgtggagccactgtaccatccctgcaagtttgtgtggacttcttgccctgtgagacctactagccctaagctaaagctgctgttagtcaggggttctgtgactgatagttgaatgcattctcaattggcatgacaaacccatatctcattttcttgagcattcattgttatcatttctcaaggctttcttttctacccactcattactttgttccaaccatttcatgtactcataactccacttataatctatccatagattgatcacaaaattatccattccagtacagaccttgaccctgacttctagacctataatatacttatgtatagatatgtgcagcatatgttttatgtatgtattcaaaacttccaactacatggatagatgtaaacataaatatatatgtatgggtattcatatagaaacattttaaattcctctaaatacatcttgggctaacatgacagtcaattttagctgaaggtacagaattctaacaaaagtacctaatattataacctacaagatgtggccaaaatgtcactcagaggaaaaattctaaccttaagtgaaattattggaacacaaagaaagactacaaaataaaaatagcaagaagatgctaaaaaaagattaatacaaaaaatcagaaattaataaaatattgcaaaatgaatatatttgaaaccaacagaccagatatgccagggcatggtgggttaagaaacagtgagagaattcacaaatgaacaatgttggaaatgagaaaggccatatactcaagatacgaggaagttttaaaaattattaaggactacttataaccataaatacgataatatagattaaatgaattttccagtaaaatatatgtgaatgacatttacttgataatagcttgcaaatgcaaaaatactaactggagcaaaatcaaaggtagtgaatgatagttaactgattgtaagctctttgaaagaagctgccttgttcactgtggggtccctgacaccagacctatgcctggtgctcagtggttattggctaagtgaatgaatgaatgaatgactgctccataaggaaagaggctaggagacttgcacaagtaaattctactaacctttaaagcacagttaatttccatgtttgagcatggaagataatgtaaggctttctacctcattctacaagactaggactttcctgatactaaaaaaccagataccacacaaagaaacccatacctcaattcagtgcatagatgtaaacatcctatgtaaaatgatgcaaaaccaaatctagctgtgtataaaagaatcacgactgaccgggcacagtggctcatgcctgtaatcccagcactttgggaggctgaggcaggtggatcacctgaggtcaggtgtttgagaccagcctgaccaacatggcaaaaccccgtctctacaaaaaatacaaaaattagctgggtgtggtggcacgcacctgtaatcccagctattctggaggctgagacaggagacttgcttgaacctgggaggcggaggttgccgtgagccaagattgcgccactgcactccagcctgggtgacagagcaagaatccgtctaaaaaaaaaaaaaacaatgtccaattgtctatttatggaaatgcaaagtgtttcaacctttggtagtctatgaacgcaattcactacattcacaaattaaagaagaaaaacaaaaaatctctgtgatggtagctgaaaaggcattcaatacaattcaacatttcttactgaatatcacattttgtaaattaggataaaagaaactttttactgtgataaaggaaatctattgcacgtaaagcagctaatggtgaacactaaacattcctatcaaaatcaggaacaaacaagaattccactactgctgccgaagtttgcctttttctggaggttctagacgctaacagaataataaaaatatattagaggtgtaaatattagaaagggaagagcaaaactctaattcctgttaaatgatctgacttttctgtttgttttctgttgctgcataacacattaccagaaacttagtgccttaagacaattcccatttgttttctcacagttctgttgtccagagtctggccgggctgcactgggttccctgattgtggcctcgagagcctgaaatcaaggtgctggctgggctgaattcctgtctggagagtcagggaaaacccacttctaagctcttgggtgttgtggtcacagttcagttcctggggttgcccagctgagctccctgtttccttgacacatgtcactctccatctcagcgacagggagtccctcacatagaaccccctcgtgcttcacatctctgaattcctcttctctctgcagctgcagaaaatgctctgcttttaaagggctcatgtgatgaggttaggtcagcccagataatctctctgtcttaaggtcaactgattggcgaccttaattatctctgcaaaatcccttctgcagtgtaacctagagggaggccagggacaggtcataagccccatcttagaattccactcaccacaacttctaagaaaatcccaaagaagcaactgatagcatgataaccagatacaagatcaaaatggaaaaatcaatcgctttccaataattcactataaaaagtactggggaaaaaatttcaagcacgtaaagaaacagaaactaaaaacagccagagataaaactaataaaaatgtgcaagacctagacaaagaaaattataaatgcttatgaatgaacacaacaaagagaccccaaaagtggggagattgagcacattcctaggtctcctttttattttctttattctttttctttttttttaattacactctgagttctgggacacatgtgctgaatgtaaaggattttatttctgctttgcttatgaagcttggtttggctggatatgaaattctgggttgaaaattcttttctttaagaatgttgaatattggcccccactctcttctggcttgtagggtttctgcagagagatttgctgttagtctgatgggcttccctttgtgggtaacacaacctttctctctggctgcccttaacattttttccttcatttcaaccttggtgaatctgatgattatgtgtcttggggttgctcttctcgaggagtatctttgtggtgttctctgtatttcctgaatctgaatgttggcctatcttgctaggttggggaagttctcctggataatatcctgaagagtgttttccagcttggttccattctccccgtcacttttaggtacaccaatcagacacaggtttggccttttcacatagtcccatatttcttggaggctttgttcattccttttcactcttttttctctaatcttgtcttctcgctttatttcattaagttgatctttaatctctgatatcctttcttctgcttgattgatttggctattggtacttgtgtatgcttcatgaagttctcgtgctatgtttatcaggtcatttatgttcttctctaagccggttattctagttagcagttcctctaaccttttttcaaggttcttagcttccttgcattgggttagaacatgctcctttagctcggaggagtttgttattacccaccttctgaagcctacttctgtcaattcgtcaaagtcactttccgtccagttttgttcccttgctggcgaggagttgtgatcctttggaggagaaaagatgttctgttttttggaattttcagcctttttgcactgttttttcctgatcttcatggatttacctacctttggtctttgatgttggtgaccttcggatggggtttctgtttggacatcctttttgttgatgttgatgctattcctttctgtttgttagttttccttctaacaatcaggagcctctgctgcaggtctgctggagtttgctggaggtccactccagaccctgtttgcctgggtatcagcagcagaggctgcagaacacaaagattgctgcatgttccttcctctggaagctttgtcccagaggggcatctgccagatgccagccggagctctcctgtatgaggtgtccgtcaacccctgctgggacgtgtctcccagttaggaggcacaggggtcaggggcccacttgaggaggcagtctgtcccttagcagagcttgagcactgtgctgggggatccaccactctcttcagagccagcaggcaagaacgtttaagtctgctgaagctgtgcccacagccaccctttcccccaggtgctctgtcccagggagatgggagttttatctgtaagcccctgattggggctgctgcctttctttcagagatgccctgcccagagaggaggaatctagagaggcagtcttgctacagaggctttgccgagctgcggtgggctccaaccagtccgaacttcttggtgactttgtttacactgtgaggagaaaaccgcctactcaagcctcagtaatggcagatgcccctcccgccaccaagctcgagcatcccagatcaacttcagactgctgtcctggtagcgagaatttcaagccagtggatcttagcttgctgggctctgtgggggtgggatccactgagcaagaccccttggctccctggcttcagccccctttccaggggagtgaacagttctgtcttgctggcgttccaggcaccactgaggtatgaaaagaaaagaaaaaatcctgcagctagcttaatgtctgcccaaatggccacccagttttgtgcttgaaacccagggccctagtggcgtaggcacccaagggaatctcctggtctgcgggttgcaaagaccatgggaaaagcgtagtatctgggccagagtacactgtccctcatggcacagtccctcacggcttcccttggttaggggagggagttccctgaccccttgcacttctcgggtgaggtgatgtcccaccctgcttcggctcaccctctgtgagctgcacccactgtctaaccagtcccaaagagatgagccgagtacctcagttggaaatgcagaaatcacccactctctgtgttgatctcgctgggagctgcagactggagctgttcctatttggccatcttgccagccacctcctgtattttgttctcataatctaatattttttttttttttttgagacagagtttctctctgtctcccaggctggagtgcagtggtttgatcttggctcactgcctcttcattctttttaaacagtaaatgaatagccaggaaaaagttcaggaagcacaagaaggagaacatggtctaccagatattaagttatactctaaattatagtagttaaacccgtgtgtgagcttacagaacgaatcaaagagagtaatgaaacccaagagagcataaacatgaaacatagaatattctactagtagcattcaagtgcagggaaagtttgaactggtcaactaagggtattgaaacaactgattctctatttagaaaaaaatgttaaattcctacctcacaacatgcagaataatatattctagatgaattacggagctaaatataaaaaacaacaacaacaaagaccttagaaaacactaaaaaaaaggagaatagattgtattttaaaatttggcgatggactacgggttttgaagcaataaaagatacagcaaggaaatttcaggaggtctgactacacaaaaattgaaatctatggaccaagaagacctcataaattaagtcaaaatgcaggcaacaaaatggcttgagctcctaaaaaattacttctcaattaattgtcctgtgacattagccttcttgaaaaggtagagatttgtaaatatgcatatccatacataatgcacctttagaggatctgataggactcagagtaaataatacccacagttacccacaggaaaggatgggacagctgacagcggagcagggaagggcgcgcagagggtgaccttaaaagatttattctatgtcaacttcatgttattggagtacttcctgacatccacatttcatttcctttttatttggttagtttaaaatatttcagaaataacgtgtttttaaaagttaaataacacataggtgtgtagagttaacattgaaagactccttcagctaacaacgattcttagcccaattctactcccaagggataatacattttgtgtgtaaatccttatagaccttattctttcattacagaattaatttgagataatttttaaaaagtatgtatacacatagataaaaaaatgggaaaacacacgtaatttcactagcataaaacgtagttggttttattcatatcccaagtattttctatgcacttataaaaatataaatagttggtgtcataagatacatattgccgtgtaaccttatttttcacatcaaaatatgtattttgagtctcatttcatgtaaatagttataattctagtattgtatacaatcatagtcatctgctttttgatggctgtgattgtatacaatactataattaaattacacccttaatatttcaatattcgggttatttctattttaatgataaacagtgcttgtaattgatactttcttgtatatatcaccatactcttttctaattactttgcttttgattttgcggttaacgttttttgtaaacaacacaagaaataccaatgatatttgtattttaaaatattatggcaaaaactatcataaaaaaagtcaaaggacaaatgatcaacagagaaatatatgtgacaaataaagagttaacatctataacacaataaaatgcttgaaaaataaaaagattttaaaatctcagtgcgaaatagtcataaaatattaatagatagttttgaagaaaataattactaacgatcaataaacatatgaaaatataattaatttgactatttgccagaaaaatgaaattttaagaaatagtaagataatttcatgcaatctatttgcttaaaagtgagaaaaaatgacaccttggtgccggaaaggattgggggaaaaggcacttgcatactttgcccgtgggaacaggaataaccgcaactgttttggaaagtgatccggcaatatccattaaaaagttaaaatgcgcataccctttggccctacaatctcatttctcagaatctactctataaaaataaaagtatctgtacttgaggatgtctattgcaacactttttggcctggcaaaaaactacaagaagtgtgaaaggcaatcttcacagaaatgtacacagcatgaatccagttttataaaacaggaaatggttttataaaatattatcaaaaacagtgtttgcctctggttatatgaatgtggtgaaagttatggcaaagagtacatctggcctttatctttgggaggcagtagtttaatataaagaagccagggctgggtgatgatgatgatgatgatgatgatgatgatggtgattttactaggagtatagattactgtctaaccaaaaaaaatttttttttgggacagagttttgctcttgtcgcccaggctggagtgcagtagtgcgatcttggctcactataatctctgcctcccgggttcaagtgattctcttgcctcagcctccctagtagctgggattacaggcgcccccaccaacacgcccgactaatttttgtatttttagtgcagacgagattttgccatgttgttcaggctagtcttgaactctgtgacctcaggtgatctgcccatctcagcctccaaagtgctgggattacaggtgtgagccaccatgcccagcctcctaactgaacgttttaaaaagagacaaataagttggactctagagtatggtgaagaacttctgcacatgtatataggtaatggggcagaaaggactgcgtcatcacccgaaaggcgcacatgtcagcagcagagtatgggtctatgcagataagaccatcgactgcctatccacataaggttatgaagcatgggcttccacaacatccctggctagaagacttgttgcccaacttccagttcctggtctcttcccttatcatctccctcaacagtctgctcaacagtctgcacctgttgagttctctccctggtggtgggttccaaaggccatataagtcaccttcagagccctttccattggctgtgggtggagaagctaggaagctgcagtcttcccttctcaccccctccttctgtccctcccgtcctatgtttcctggccagcctgtgacagctttgctgggatatgctgtaatgtccagagttggatccagcaccagcaggatgaaaatagaatctgggaaactagcatagtactcaccctgctcaaaatcagaaagcctggagaggacaagaggaccgggaaatacccacatttcttctgtccccagcaggagtctggagttgcaggaaccaggaaaagtcagggtaccaggaacacacagtcagttgaaatgaggacacgaggaactggcttctctctctttcctgcccctccttggagccctggtgctggctgctgcattactcagccatctgcatgagggttgcctgggtggcgatctctggaatcacaacattctggggtgacgttcccaactaaaaataattcctaagcctgggcatttggcactctagtgcagatccaaagaggcaactccttcagtctctgaccttgaaatgagattccccccaacccaccccccacccccccgcaagagcaagaatgagcagctcttcggctccttcagccagggagcaaacaagaagtggcctctgaaagatcctaaaaccatcctaacataaaaatgcccccattctctttatgtgaactgcgtggctaaaactatcctaacataaaaatgcccccattctctttatgtgagctgcgtggccggtcagccacttttcctggactgtgtggagcaggaagcagctgcccttctcaccaacctcccgcttctcacctcattcaatgcttacaaggagggactcactggatttgaatgaatgacaggagggactttcattccagttgccttgctgttcagtctggcacgtcacatgccaggtggtacagcagagtgacttggcaggctctggaaacacactgcaggaggttcgtgagttcatgtcccgctacagacgttgggattcaggacacttctctaggcctcagttttcccaactgaaaatgaggataatgaccactcatgaatgagttaccgcagatgaagcactcagcactgagattttccagaggtatcaagggcccttcttttttattccctagtgaaacacgttgcctgctcccttataagaaagtatcattgaaaagggttttaagatgcctgacttgaatcacattcgtgagattctacatgtgcacggggctatcctctgctgctggcatcacgataggttgttcacatttattatttctacttttcataacaacccagctggccaaaagtaccactatttttatgagtggtaagctggaacttagccctgtttagggccccctgttttcctctaccctgctgcctcccgtgttccccaccatgctgagggtgtatgggcatcctggatgtgcgtgatatgtaaggcacgtggtgctggtgagacgtaggcattcccgggcgatggtctacagcgcctgcttcactcccaagtgtttactgatgcagctggaaacaagacagaggaaactcctctcagagaggctacatcacagtggacatagatggacagtaaacaattaaataagttagatacacagcatgccaagccatggtaaatgcatggagaaaatcaatcagggaggcaaacggggagttctgcatgggctgggctggaagagggatgatttgtgaattttaaacaagatgaccacttctgaattcttctctgaggtaaccataacctactggtgaactctaaacagtgtatgggctgtgagaggtgctggccagcgaatctgaactgggggctctgaggggaaaagcagttttgcagccatgacctagagccacactctttcatatggttgccaccagccatctgtggctatttaaagtatttaaagttacataaaattaaaatttcagtactttagtcatacccctcagtggccacatgtactggatggtgcatgtctggaacattccatccttgtagaacattctgcgggacagcgccattctcaagtaaagacgtggcatatggcagtccgtgagtgggaggcatggcactgtagttttgggatgtggtgtaggtttggtgataatggggtcaaggcagtgatcttgaaggaagcggttatagctccaggaggtatgtgaagcagctacctttggcaaaacactcataatacaaaagagcacacagatatacatcttcaggcaaaactttaattcagtcaacctgacttaaaatcaccatactccttccttctcctcagcttcatcatccccatcactacattatcaatatcatcatacatctgccaccaacctcctttgattactttttttcctgtgataatgtataatgcaacaggatgggttttgcttgtaagtataaaatcaacaggttctcttaggtttaaaaaattacacaaatgcccaaacccttgtgggctttaggtaattctttaggtacttctctcaataattaatcagtagaactaatagaaactgatagaaaataagcaactcatggaacaattatcagtttcataataacccaagatagttcattaagaactagaaaaaaggctgtagcataatgttcaaaagtaaaatattagtaaatgtgatgcatgatacttgggtggatcttgtgtcaaaagaaaaaagtcaactgtgaaagatattcttaggacaaagaaaaaaatttgaatatggaccaaagacgtagacaatagtattgtgagctgggcatggtggcgtatacctgtaatcccagcactttgggaggtcaaagtgggattgtttgagcccaggagtttgaaaccagcctgggcaacatggtgaaaccccatctctacaaaaaatacaaaaattagctgggtgtggtggcatgtgcctgtaattccagctacttgggaggctgtgttgagagtccaggagttcaaggctacataagccatgatctcaccactgcactccagtctggatgacagagtgatacctgtgtaaaaaaataataataattagtattctatcaatgttaatttcctgagtgtgataattatataattatctcatttaataggagagaaatgctaaagcattcaagggttcagtgtcatgatgcttgtaattaactctcagatgcttcctcaaaaaaaaaatcacatatatgtatatataatacaaatatggcaaaacagtaacaattggtaaatctaggtaaggatatgtagacgtccacttgattattttttgcaagttttctgtatgttgagtatttaataagttggagagaaactaaaggattttttaaaaatgaagtaatatgagaaactctctactacagttaccatgtttataagcctttcagaagaactagtagataaatagtttattttacatatttgaattaccactgaaaatttttttctccctttcaaaacattggtcccagcttattaaaaggattacgctttgcacttgaatttaaagccaaatttctccaagcgcttttgcataaagatttgttaatgaaatcttaacttttgggataaaaccttagcatgtcagaatcagactcttgggcatctcaagtgcaaattccttacactccttatgagtttggtcatccctctttggcggagtcagttacatttctacagaggatttcaaggagaaatgttaagatactcacgcacgctgaggggcctccagcagccacgtgccctgcctcttagggccactctgggtcacagaggacaggagaaagaaacttgggtcatggtgcaaaggagaatgaagaaaacttaccagtcattttggatcagagagagagaaaaaaaggaaacctctcccttctgttcacatcaattaggactctttgcaataagtgacagaaaaactcaacaccagatgaagcaagaaagggaactgaatgactaaactactgaaatgtccagaggaggacaggcagattccactgctcagtgtcacaagacttggtgtttttttccctctcagctctgcctcttcctgtgggctctaacttcaggcccttctctcaggggagcaaaatggctgccaaggccccagcccttatccttttactgtaaaccagtgaggagaagcaaagggctgtttcccagaagtcccaggagatacttcattgggtctcaaggtgtcacatgtccacccctgagccaattagagtgagggaggaaatgagtgtgtgcctggatgccgagacacaccctcacctactccatgacctggtgccctgaggacgggatcacagtggggccccgaatgactgctagcagaagtggggtgcatgactctgggtttccattacttcctggaaaccattagataacttaatggagcgtgcaacttagggtagaaaagagggttttaaggtggaaggagaagaagaaacatcttactcttttgaaacactgtgaatctgcaaaagacaaaacattcctttcttttgcatagaaatattttttgtttctgagcttaatggcactcggaattggattgagaatgttgtatctttccctatacgccattggaacagaaaattctctcacatttctggagtggctccccaccctgagccctgccctcctgtacccgccaggaactcctgagggtgccttctggctggaacagcagcttcctggaatggaaaagtctaagtgtggaactctgggctgtctgccctcaccactgtcagcaccattgcacggagggctaagcagcggaccactgcactagggatgtacaagaagagtccgggggtgcctgaggctggttttcccagaagcagacactgagattaagatctgagtgcaagggatgttttaggcactgatgctgggaagcactgggaggggcgtggatgtgaaacagagaagagaaggaagtcgatgcacagggtgctttacagacgttatcgctgtgggcagtagtggctcaaccccactggaagcctctagaggaaagttaggacacacgtcagactcaggtcccgcgtgtgagtcaggctccctgggcccttcaatggagaagtgccgctgcatctgtgagaagccactactgtgcaagcttccagtgggtgccacggcgggcgatgggtgcaactcagccatgtccaggagaggagcatcccaggcacttgttggaagcatcattctagggatgctgttgcctgaggagccaaacaaagaggtgattgtatccagggaaacaggacagactctcaggtcccctgggaggtgagaacatcttctttctcaggcccagatgtcacataactcacaaaaagccaaatgatggattacaaactgtaggagggctggacacacaggattagctactggggctcccctcactagccggggcagaagatggcagcactgcccagctttgcattttgaggaacccctgctcacacatcgtggaggaatctgaatgacaatctgagcaaaagcctgaatatattcactttcttgctgaacagggttacagaggagacttgtagcaatgaaataaaagggcaactacaggtggaaagtgagctaagggtcatgagtcctcatgcactccaggcaccaaagccgatttggtaaaagaacactgggccctcaacaggcaaatgaagaagctggtcatcttcagagtggaaatgctaaggctctcgcaccaagacaaatagactgagtctgaatctcacctgtactagccatgcatctttgggcatgtgattcaacctctttaagcttttagtttctcatcagcaaagttgggatgtaaaatgtaagtctgtcttgagggttagatgggatggtagatggcatgtgtaaagtgccctcgttatgggaactcagtgactgagaggcatctgtggggccagccctgctgtcattaggtatgaatatcattacaaaggctacaactggttaccttacatgctatttctataagaaggccagggaaaagaaagaacaaacacacaaaaaatagacacaagaggagaaactaagatcccctagggagatagttgactttggcaagctattaatatagtgaagttattaatgcatgtggagtgtgtccattttcttggcatctattcagtttcctattttctctagagggatgctaagtggacagggtgggaaaggaataggaaggccaagaaaaagctattatgggtgaccctttcccactcacccagaagaacttcaggaatggtccaggcttgaatcagcaactagctcagcaggtcttccatgtgagcctctttggctgaagccacagacatcctgactttgtgctcaaaatagagcactgattcagaaggcgtcttcataagagactgaaatgaaacagcaaattgtgctgtcacaaatgacgaaggagggttttaaaggactgttttagggggcgcttctttctcccctttgaaggctgaggtcattatctgcactgtgggcatgtgggctcagagcctgtgtttccgtggcactgtgggttggcagcttattcatgtggtggtgaagactcatgacttgctgttcttgcccttcattgcagggctcagtggctaaagggctttattgttgctgccatgtaaagccttctgtcctatggaagctccgtgctctggcatcatctatttcaggagcctgtgacagtggcagcgtcataccctaaagctggaacttacagacaaaagcgatgggccagtatcggtcagtgttctaaaagatgagctttgatttgacttaagtgtttcccctccacaacagcatgatagaccaagatacttctgactacatctctctgtggatctgcatctgtcagaggggaacagagtagattgtctacccacctcagaatgctcccagagacaagacagccccagtcccttccctgtaggagtggggagtccaaccattcattggcagaaagagccaagtacacatattcagttcaaactcatagcacatttaaaaacgttcgctcattttgaaatcatttcagatgtacaagagttgcaagaatattacaaacaacccccatagacccttcactcagattcctcagatgttagcattttaccatgtttgtcttatcattctctatacatacatactagttttctgaaccttttgaaagaaagtggcagccaaaacctcctctgctcctaaacagttcaatatgtaattcccaaaaaacaaggacattctttacataatacaagtatcaacatcagaaaatccacattcaaataatattatctaatctccaggacttgttcagatttcaccaattgtcccagtaatgtcttttattttattttattttatttttttttttagacagagtctcgctctgtcacccaggctggagtgcagtggcgctatcttggctcactgcagcctccgcctcccaggttcaagtgattctcctgcctcagcctcccaagtagctgggattaaaggtgcccaccaccacacccggctaactttttgtattttcagtagagacagggtttcaccatgttggccagactggtcttgaactcctgatctcaggtgatccacctgcctcggcctcccaaagtgctgggattaaaggcgtgagccatggcatgcagctcccgtaatgtctttaagagcaaaagaaaaataaattcttgtctgggatccatacattgcatttagttgtcatagctccttagtctcttttgatgtggagcagttcctcagttttaatgagattggtatttttgaggcatacaagctatccacttcataaaatgtccataagttttcatcctaaagaatgaattaatgagaaaatcaccttttggtaacagtcatagttatattgactcagacagctgtcagcggaagacagaactagctggtgaggaggaataggatgttttcatgatctcagtgcagctcctcgcggaatactgatggattacgaagggaaaaatagtcactttacactggtgcaggctggcaggcctcaccttaaccagcggatcacagctggcatcagagatggtggacttcacgtacttcctgatatgatgtgctgagaaaaacatagctttttgcacttctcttgcttcccaccaaaattgcgtatcctgaatctattcatgaagaaacctcaaacctaacacattagaatgttatcacaacatgggaaaaatctggactacaaactttttacaggcaggagacctccgcaacactagcagccttctctaagatgagttcactagacctttgctttcagagcctcagcgaggccttttcaggctctccctgctgggtcaagtctcctactctaaacacaagagggacttgctagcccgccccaattcccagtggtcctcggccttagttccttgttttggaacctctttttcctacagagacttgaagatcattcaacacttccagttttgagacaaagctgtgtccaagcaaggttgtccatgagcctcgactgggcttccctcctggtcctgcacagcccaggagctgctgcctcaaggtcatcttcactgaaccctgcacggtgctggacagccccagctctgaagtgtgggtcaggcctgaacactagccctgcagcctggtcgagtgcccatggctctgtctccattttctcatcggattcatgggaccaaggacgccgatacagtagggctgtggacagcataggtcgatgtcactgtagaatggttatcacggagctcagcatataggcaacgtgcagtcagcgttagcttttggtattacagtcgtcagcgggcttttaagcctatacattctgaagccaaagatttgcctggtgaaagtatttacaagtgagtgacttgcctgggttcaaatcctctctccactatgtcctacctctatgctctttggcaaatgacttagcttcctttatgagataattgcaaggatcaattaaatggtgcctggcacagagtatgagctaggtgagcttcagctattcttcttcttagctccttttttttccccaaaaaaagcttacatttgggtgaaacttctgggtttatgtgcacactccccttgtgatgctgatcctcactagaagaagaaagggatcatcttccattttacagacaagaggactcagggaaatcagggaaattacactacctcagcaaaactacacatttgaaatagcaaagtggggcattaatcctgggtcttgaacacaagcatactgttctttacagctgtcattcttcccccaaatatttgtgaaatgctatgtgccaagtgctgggccaggcgctgcaaacacaaagcccctgagtgggaggaatcaagtgagaagaggagatgggcggggttccagggaggtgagggtgtggcacctgctctaacataatgtgcctctaactcaggcgagggctcagggacagtgatgcttgagacaggtactagagggatttagaataagcagatggagtagctgaaagatgaaggaaatccaggaaaaatagcaatgtgaaggcaaggagggtgaaacaggcagagatatttggaggcacaagtaactgagaatggctggagccacaggtgctggagggggtgctgggtatgggtgaaagcaatctgagtgggcttcctggcaggctggagattcacactgttgcagctctgggcgattgcccacaaggcatcttcagggaggaggttttttttgtttgtttgtttgtttttaatgcttttctcctagagtctcaggatagtcattttagcactcagttttaaatgcttccaccaagcatgctgtaattctatttaattactctccttccttccccatcggagggtcccatcccttgatcagcctccatgtggtgtttggagcatgtgatgggagactggcggcccccacagccaccccagggcctgtgctaagggaacagctggtactgttctcagcagatctcagtggtgacctgcaggaatacaccagcaaaccagggttgacccagagccacaggggacaagctcatgtcacagagcagccaaccaggtgagtgacaaacctacctcttcttgaatacactaagggatggaggtattaggcaggcagagaagttgcatttggatgtgtcactgtgaggtacccatggaaggcccctaaggagatgccccatacgcagctagcagtttgcatctggagctcagaagagaagccaggctggggatggaggttttggtcatcagcacacctgtggaagttcaagtcttgggtgaggtcactcacggaatgagaagagcctgcaatgaaaggtgaggtcttagagaaagccaaaacttcaggatatacaacacctgatttcctttttatactgttttttacaggcctcctcccagccataaccaaaaattactttttcagagagctgcataagtccaatatgctaatatgctaaggagacatgtcttgatttagagctcataacattatcttcctgaccagttactgcgttcgagggctcacaattttttccctttaaatgatagataataatttacatatttatggggcacacgtgagttggttacatgcatagaatatgcacaaggatgaagtcagggtattttgggtgcccatcactttgagtgtttatcatttttgtgtgttgggagcatttttagagcattcaagtcctctcttctagtaactttaaaatgtacacaatattgttgcttaagtatactttcctagtctgctattgtattagtctgttctcatgctgctaataaagacatacccaagactgggtaatttataaaggaaagaggtttaatggactcacagttccacatggctggggaggcctcacaatcatgggggaaggcgaatgagaagcaaagtcacgtcttacatagcggcaggcaagagagcatgtgccagggaactcccctttataaaaccatcagatttcatgaggtttattcactattgcgagaacagcacgggaaagacctgtccccatgattcaattacctcccaccaggtccctctcatgacacgtgggaattatgggaaccacaattcaagatgagatttgggtggggacacagtgaaaccctatcagctatcaaaggatagcttattttttctaactgtatgtttgtacccataaccaacctctttttatccctctccttttgacttttccatttctgatatctatcattttattctccatctccatgaaatcaactttgttagctcccacatgagtgagaccatggagtatttgtatttccgagcctggcttattcctcttaacataatggcctctagttccattcatgtttctgtaaatgacaggacttcattcttttttatggctgaataatattccaccatgtatgtataccacattttctttatccattcatccaatgatgcacacttaggttgattccgtatcttggctattgtcaatagtgctgtgataaacatgtgagtgtaggtatccctttaatatactgatttcttttcctttggataaatacccagtagtgggattgctggatgatacagtagttctatttttacttttttgcgaaacatccatgttgttttccatcgtagctatactaatttacattcccaccaacagagtataagagttcctttttctctgaattgttgccagtatctgttgttttttgtctttttaataatagccattctgactggggtgagataatatctcactgtggttttgatttgcatttccctgatgattagtgatgttgaggagctcacattttaattttgtaaggtcctcctcattctctctgagttccctgtcattctcggtcaatttcagagtatcaggggcaggcatttttgcccgatggtgttttggaaagaggaatagtctctctaaataactatcctgcttcctcttcatttccataccaaagtcccttcacttcacccaccacaacaataaataaattcacagaaacaatggggctaacgaaatgcttcctctcacaggttctaggggcagcatgatctttggacagttttgcttggtggctatatattccaccccagcataatttcttgagagcatatatattacttttcccttagtattccacattagctaactggccgttttagtatggtcctgtaggaacataaacatttagagaatttcttgtaatgacaagtagagataatcggtttgaggccagtgagctagttatgtttaggaaaatcaccatgggatttaagatgatgcattgatgtaatgcaattggtggtttatgaaaattcttttagactaacctcggccgtataagcacaaccacattccttgctagtgaataggaggcagggcccagtggaatcatttttaaagtgttccattacaaacctttcacttctacctctcaagggagaaggggactggagggggagcagggaggacttcacagcgaaattttctgtggaagcctgtttgaagctataagtagtcaaaggaaaaatccagaaatagtttaggaaattagtcatctgtctccaaactgtgttcagttacagttttgggttccactttatgaaatgtaaaaaaaaaaaaaaaaaaaacagaaatctggaaagattaataatcatttgtgtaagggtcaaaaaggtccagtttttgcccagaaagaggaaaaaaagttcccatttgctaaaatattgtcaaaataattcccaggatggaaaattacattctgggaactgggaaacatgttgactttctctacttttactagttttgcaatactaaaatgttgataattaggttatactagatgtctaatgttgcttattttaaagcacgagtacataaattattaagtgcatttttcagtgcacacacacacagacacgaggaagctacccattaatatgtgcctatcctctatttttttttttaagtgagctaaaggagaactaaaatgggtcgggtgcgggggaagtagtattccactatttctatacctattagttcaccaacttactatcatgatcattttaaggcagttattttgctcttcactgttctgttaaaacctgtgttttaaagaataagggagtctagggaaatggaatggaagaattcatacagagcttatttttaaaagaaaagaaaaagtctttgcagccataacgaatcagcactgccagccttggtagggagaggctggggagaaacctgactctttactagaggccatgccaggctttcccggagagtgtttggcttgggtatttctcaggcattgataaaaagcttcttgccatcggagtgaacaggccagagagcgtcttgtacttagactgaagacacttgtaagaagttagagagcggagactctactgagctgacgcagggctgcacggtgtttactacaacccctgcctcagttgggcatgtttggttgcaggtcacagaatatgcaaaagtggttccactttttggaaaagcggttgaagatgctcacacatgcctcagtgcatgcatcaccagggcatctggttaaaatgcaaattctggcccagcaggtctgggtgggaccctggatcctgaattttagccatctccaggtgctattgattctgttggcccaaggaccacgctgggtagcaacagtttaaaaatccagcgctgattgccttctacagcaacatgtctggagactggacagtgcccaggttggtgcagtggctggagccactggccttccattctattcccctagacgctgttattctttaagacatacattttaacagaacatcgaagaacaaaatgactgccttaaaattatcatgatagtaagttggtgtactaataggcatagtaacatgaacgacaaaagtcagcccatcctccctcctgtcagccgcaggcttctgtcttcacagcggcaagggccacatcctcacacacacacttttcccttcttctgtccccccaacccccaagacagtctggtggccaggatggcttcaggcccacacctggcttcacaagaagcgggaaaagcagccatctggaatttccagctcctgtgggaaggggcgccctgtcagcgaagcagtgggcatagggacggaccgtagcagggtggacaccaacagtctctcaccaccatcccccactctgtcctccccaggccccagcaacaagggggaggtgcctccattgtgcacaaacggaaaagcaggttttactacattgaatgcaataaggaaaatcagcaagtaaagtgtatttgagattttttgtttttttttttttttttttttttgagacggagtctctctctgtcgcccagactggagtgcagtggcgcgatctcggctcactgcaagctccgcctcccaggttcacgccattctcctgcctcagcctcccaagtagctgagactacaggcgcccaccactagtgtagtcctttaaaatttgagattttaaaggaaagttctgcttttacctaggcgactgtattacatctaacactacctagcaattggagatgcgttgctgatgtgttctctctgatgatcatcagcatgttatttaatctcttgagattcaccagtctcctctctatcagggagtgaccatatcctcccctctgaattagattacactacatagattgcatgtgaaattatctcgctagaattttatgtaaaagaatcaagctcagtgcatggcacgtgacgggtactcaacaaaaacaaagctgtataatatagtacatagggttattcttgtgtctgtgtgtgtatgtgtgcttatgcacagtatgagaagattgattatatattacatttctactttcagtttttctatgccaattgaaataaatccgtgacaatattacctaggtcatcttaattagtcatgcagttagagatgggaggtctcagtcactccctggcagctatctgaattgctggtagactccaagaagaaatgcaccactttttaacgtactggcctcacaaatccaaactgaaaaagtgactgcaaatatgccagtcaccaccaataataacatagttttactagttgcagggatggaaacatcactgtctaggatgtctgcatccattagttaactgaaccagcttctaatagttttatgcctactcaaggtaatgtgacttggcttaaacaaacatgaatgttaagagttcacaattaaatcatttattcatctatcactaatttgaaaaatactgaaaatatttgttaaccatggtataaaaatatatctaaccaactttaatagttgagtaagcatttgacaccaccattccatacttaaatacctatttaacgtgaagtttgtttctttttgtcttgcacagaactcaaggaagaaacatttttgccagtgagcatatttttagttagtgtgcaactaaatttgtttcttttaaatagaatatttgatcttatttgttcttatgctagacttgtataattatacttgtcaggggcaaacaaataatgtaatgattctgaaatattatttcttaaggaaaataattatacaatgatatttatgtacttgaaagcatgttatcttttaaagttttactgtgggaggccataaacttattcaaatgatgctgaaattgctcaaaatagttttagagtctctctctttggatatgggctcaaaagccaatgcataaattatataaaatttatatcattttgtgaccaatctgaagaactgtagtaacaaaaccaaaataatttaatttggtttgcaaatgctctacaaagtacaattatatttgctctgacttgtgaggttttctaaaaaaatcaaataactgagcatgtattatttttacagtaaattaaataaaagttgggataaaaattctcgaatattatcatatatgacaaaaattgctaagtgaaataatttaagattgtaatgaagggacataaagtaattgtaaaaatagagtttcaaaaaatagtgacttctctgagaggaacttactctgaagtgtgaatataaaaaaaatcaagctggcactttggctaataagagtgcaaaatgctacaactctttgggaggggcatttggcaatttctagcaaaatcacatagacatttatctttcaatcttgcaaacttacttcttggaatttttctttgagataccacatggcagctgcaaatcaattcatgtgtagttattcactgtgccataatttgagatagctaatggtggaagcaatgtaaatgcctaaccacaggaaacaaacacaaggcaagctggggatgctttgctgtgccagaaagcaagaaaaatgctaaaacaaagcaaaaatctcagagggatatgtgagaagaacacaggtgctcactgaaagggactcccaccagccatagttgggacaatttgaacatttaaaaagggcgtaatgggttatattacattaactaaaataaacaaagaaatcttcaagtccttagtaatacatttaaaataggggcaaggcagctcttctttataaagtaatactttttaataaatatcggaggaatgaaggaatttaacaataaaattttgcagtcaccacggtaatgactgatttaggcaagaatcagcagtgcacctaaaatcattggctgaagagttaggcacacaatctcaaagcatcacccacaggttatttttaagtataaagaggaaaaggatacaccttgaagaataaatggaagtcagaattgcccaatcatgggacacactaatgatgtaaaggaagcagactacagtgccaggtagttttcttgtcaaagctgtttaaacttcatcttgctaacttaagatatataaatttaggaaagaagactttatttcttgtaaagggttacagcctgcaaggtggccatcctgcaggctgggaagtgggcctccagcaaagaccagagacaggcactttgaaggaggagaagttggatttggagctcatagtgaatgggttggctaaacctactatttgacagtttacagggaagctatgaatattcccaaacatagacccatgttcatcttgggatagagacttaacatttaaatgtattactgttaggttctatgtgatcagaggtgcagcagagacacgatggcactagtcttcagcctttgcgaaccgaccagagccagtctatggttggtgattttcttatcaggaggaggttactgattcactgccttgtccagtcaaaactgtagtcatggctggtgcagcaggggttcagttagtcagcatctgtgagcccatgagtcataattgttttaatattgcttatctcaagtctagcccttgtttagctgctagagaaaaagaaaaagagaaaccttgtggcagttagaacatagtttactctttaagtgtaggagtgggtgacttcactggcatgaccttaggtcctgtttataatttggtatcttattgccccaaagagcctgttctgtcagtcttctgatctccattttaacgtgaatgctggtcagttgttttgtctaaaccccagacgggggtggggcggggcagcggggagtataacgaggcgtgtctgaccttctgtttcatcatgagtttctctggggttcccttggccaagaggaggttggtttggtcagtcgaagaggggggcttagatttattttttgtttgcaatctaatcaagataaaaaattaagcaaatccagagagtggatgattctacaagtcgacttcaaaaagctaaggtcttgatcagcaaatcactgtgaggggactgaagaagtgtggtagccagctgtcatgtgaggtctttgattgtatcctgaatttataaaacagaaaacagcaatgaagatcattttggtgacaactgaagaaattttaataccatcatattaaatattgaatttttggagttgttaatgattttgtggttaattggaaagtatctttgttcttgagaggtgcacactgaagcggaagtgatgactgcagcttatttcccaatgtgtgtctgcatttatagagagaaaaaaggagcaacaaagtaatgtggcaaaacattaacaatcggtgaatttggagggagagtttatgggtgttcatcgtactattatttctattttcctgcaagttttagatgttttgaaagaaattggggaatattcagctgatgattttacagctacacttgatatattaatctatggaatgtggtaagattggtataaattacattatttttatcatttaaagtagaccctaatatcactggcaggaaccaagagtaggtattgataaaacctgtatacattagaactagttggaaagttactaatcgggctgtagcctcctaatgcagagtttgcacacgatacacactacaatcttttgttaatcagcgaggtctatgttttcaccagtattgttcactcaatactaagtaatttcaattcacttagtatcgtttacatttacaattaagttgttagtatcacttaaatttacaattataatttacacttacaatttacaataatacaattacttagtattgagtaaatactaaggctgaaagagttccacctacaaatgcctcctctatgcggatgccaaatgtggagcctatagttggagaggtgtcagcacctttcaggagcactaattcagaccatggccacagtgactaaattatccaaacctaaatggagcacacatctggctacatgacccaaattttcatctcttatttatttttaatgggccaattttcatattgaaggagaaataaggagaggtctgaaaattggcttcattaaacaattaagctcttaaatcctgacagtgatggaatatttggtgtagagaataacaattttcatagatgatgattccatcataatagagggctgaaattcccaaagaattccaagtgaggcctccaatacagcatgcgattgcccatggagaatgttattctcatctgcaatttgttagtgcttttcatcaacacataattatttcagctaataaaccagctaagtatgctctaatgaaaagtatcccaaagagagagaaagggaattactaaggtaaagaaagccctcaagcttctaagtatacaaaattacacctagttgtttattgagaatgtcaataaaacccgctcctaagcatgtggtgcactattcctaggtgtacatcactcaaactatgttcgagaactgatctttcctctttcaggttatcgtggaaaagagccagggtgcaggtgtttcatgtttatccacaactctactgtttcctaggagccctgacatctttatgagtctttaaaaaaagttctcctcctcactccagtcccctgtgctttatcaacaacaaatgactctctcccgtttttacaaggggccatccactctcctgcgttcttctcatacttcttcgttccctctaccatacctaattatcagtgcttttgaagacccaaagcccctttttatagtagagtgccttcacatcagggaggaatatcagctgactttttaatagtgcaaaatgcaaatcataagccctccttacactctcatatggcgctccggcttgcttgcgaagattggcacaatcccatcactgatcaatactgatgttcccggtgagtcatctttctgtataagaaaccacactgagacttggtggcttcaacatcaacaaccatcgatttgttcatgattgcgcaatttgggcagggcttgcggggacagcttgtctcttttctgtgtgccattagtggggcagctcaaatgtggctgcatcatccatgtccacatggcctcctcatgaggctggccttctggtgctggcagttggtgagggactctgccaggggtattgacaagggggcttcagctttcctctgtgtggcctccccatgtggctagggtgggcttctcacagcatggcagtctcagaataatgaggctttttatatggctgctggcttccccccagaaccgaaaaagtggaagcctccagccttcttaaggtttaggcctggacctggcaaagcgtcacttccaccacgttcttctggttaaggtgaatcacaagagaccagattcaaggggaggaatgacacgaggatgtgaataccagcaggtgacatttattgggggccatcaatgtgtcaaattaccacatcattcgactcatcaagaaaagattgaattcagaccaacacattgtgtgagaaatgtgtatgatcactacaaagttttgcatttaaaatgctaacatttaaaaaataacatgtactgtttcaggggtagtgttttcaggtcccgtatggagacatgaagtaactgcttcctcattgattctggatgctgagtcatggctgtccatgcctcatgctgcagacgcagtttcaggcttgtcactttgggtctgactagtcaacaagtacagtgggcaggtgtgggggtccctactctccacccaggctgagggtcagggtcagacaagctttgatgatagagaacagatgagggcagtgagaccaatgtgctggaagaagggaggccccagtgacgcacaccagtaatggctggagaaaaccaaaaagaccagtctgcaagggaatgaaaggggaaggaggtcacgtcagcagcagagtagaagcagctgtttctgtttcttgccttccaccaacaaagagagagctatggatcttcctttcaaatcaccgcagctccgttccttcttctgtttgaagggaggatttaggctcatgtaagaaggctgggagaattctggtgtccaggatgttgaactggcatgttgaagggaagagttggggttattggccaatgtgcccaaagggatggctccaccccctcgccaaagccacactaggaataagatggccatgcattttactcctggatgtcttaggcccctgagtactgcatgaaggaatatgcactccaatttgattttgagtcctgtagggccctcttttctaggattcccaatgaatgtaacaatgtagcactggcacctttacctcctcccctcgatgagtcagcaggtgaagctggtaaacactatctgccaaaggatttcatgttgcttccaggtttgaaatcttgtctcactgatacagttctattgtatgtatgctaaaatgttagactagccaggatggttcaataacttatggggagagtgagctgaaatatttgattttatttttattttatttttctgaggcaggttctcactctgttgcccaggctggagtgcagtgatgtgatcatagctcactgcagcctcagtctccctggctcaagtgatcctcctgcctcagcctcccaagtagatgtgactacaggtgtgtaccaccacacctggctaatttttaaaatttatttttcatagagatggggctgcgctgtgttgcgcaggctagtctcaaactcctgggctcaagtgatcctcccaccttggcctcccaaagtgccaggattacgggagagagccatgagtcccagcctggactattttaaataaaggcaatatttaggaagtccggcctaggggattggacccaggggctagcccaggagtgtagaatgacttaaacaatagtgaatatgaaggaacgtattatcagtcctggagaaaacagtgatgggaatgaatttctgtgggtgtaggaagctgggtgactgagtgctgtcatctgtaggcaggcatgtcctgctctgtaggtgagtcccctcttctgatatacaggtgcttcataccaaccacagctaccgtctcctgctgatgaggacagacaggaagggaagcatctggagggactgatcctgcttctttggttaaactctgacagatacattcaaaaataaaaaagacattgcagaaaatttatctccagcagaactgtgctacaagaaataccagaagtcctttttttttttttttttttgagacagagtcttgctctgtcgcccaggctggagtgcagtggctcgatctcggctcactgcaagctccgcctcccgggttcacgccattcttctgcctcagcttcccgagtagctgggactacaggcgcccgccaccatgcctggctaattttttgtatttttagtagagacggggtttcaccatgttagccaggatggtctcgatctcctgaccgcgtgatccgcccgccttggcctcccaaagtgctgggattacaggcgtgagccaccgtgcccggcctagaagttcttctttaacctgaagggaaatgacacagctggaatccagaaattatttcctctagaaaacggaggaagagggaatacttcaggagcaagagggaattacttcatttatgagatcaacataaccttgatacaaaaatgaaaccaagacattgcaataaaagaaaatcgcagacattagtatccctcatgaacatagacatgaaaatccttgacaaaaatcttagcaaaccaaaatgcacacatttataaaagggtgacatatcctgatttaataggggttatcccaggaattcatggatggtattgaatgaatttaacattcaaaaactcaatcaatataatttaccagattttcaacagttaaatatattttagaagttaaatataatcatcccagtagatgcagtgaaagtatttggcaaaattcaacatatattcatgataaaaactctccacaaactaggaatgtattgtagattagttgcagaattaggaaaagtaaacttacacacagaccagatgcaacatttcaagtatctaaaaattgaggggggtgggaaggaagcttaaaagtcacatagtctttatccttgcgtttgagagcctcccagcaaccttgaggcaaactatcatattcatataaaagttcaaggacccacaactctaaagagagatttcaaatcctcaaagcatgctcagctaatagctgttgagttaattaggaggactaagattagaatattaaatctttgaagaaaatgtaatggtatggtttaattcagagaagaggttgaggagtaagcttataacacttttcaaagctgaaatgagctaagcacttggatcagtgttccccaaatgaaaggatgaaaggattcacctggaacccttgtttaaggatcacacgcccaggtctctactctgcagactgggattttgaggtggggcaactgttcctgttgaattgtcattatcggctaagtctgagaaactctagatttagatgcaccaaaaaatgcctatggcagtaatgtccctgtgaaagtgtttaagataggtatgtttgttttatcattaagtacaatatttgggtttagttttgatagatactctttattggccggacacggtggctcatgcctttaaatcccagcagtttgggaggccaaagtaggtggattgcttgagctcaggacctcaaggccagcctgggcaacatggtgaaaccccgtctctaaaaagaaaagaaaagaaaagaaaaaatgtagctgggtatgtgagtaagatatgtgagtcttagtagttgtctgaaaatgttccattgccacctttcaggtaggatcaagcatcagagtctcaaaggcagtattaccagtatggaaaaaaaatcccatagacagtaacagagctctttcttagcaatgccgtgtttccaaccctcctgatgtcacagaagatgagaatgtttggaaaaacatgaacattgatggctctgagtcttgaagaaatcccaaagcatgcacctataatcccagctacttgggggctgaggtgagaggatcacttgagcccgggaggtcgaggctgcagtgagccgtgtttgcaccactgcgctctagcctgggcaacgaagtgagactttgtctcaaaaaaaaaaaaaaaaaaaaaaaaaaaaaaaaaaaaccaacaacaaagaaaacctatttattaagggaatttccatgcattcctgttgtactaaaatattgctttcgaaaaagaaaatcaagacgttgaattatgtataatgcctcttagtttccatagatatgttttttctaattttataataaaggaatacaataaattatattttagaaattttcaaggttgagccatcctagaataaattgacttgatcttgatttattctacttttagtaaacatgtaagatttgataatatatatgtaagatctttgcaatactagccataaagtgggatcatttgatcattttcctccagaaaatggaggaagagggaatacttcaagaggaagagggaatgacttcatctgtgagatcaacataaccttgatataaaaatgaaaccaagacattgcaagaaaagaaaatcacagacatcagtatccctcatgaacatagacatgaaaatccttgacaaaaatcttagcaaaccatctgtgccatcttcctcaggttcagtaatcagagctatggaggctaccataaaaaagaaaaattcccaatttttttcctatgcacaatcataagaaaagatcctttaagtttactagaacacaaattttaggggctagggttatggttagaacacgttgcttaggatgtttagaagcagacatgtgatgcctctccatgttttctgtgctgctctatctggtcaggtttttttctaagtttagtaactatgatgaccaaaagaggagtagtggctgtgacccttcttaacatcgaggagacctatggtaatatttctacccacaaatgacattgtgcattaaaagatttcatctaccaaaccgattgctttcattaaggaaaaacaaataaattcctccactttattaatgatatctgagtacacaaaactcagtagcaacagaaatgataacccacagcagtaagcaagtataaaaataggcagtaaactggctaaaccccaggctcatgaaaagaaacagaccattctagttagcctctgcagacttattatttataaatgttttgtttccattaagctttaggaaagattgaaaataactcccaggctgctaaaattactattgttgcactttcaaggatcaaaagactccatgttgaggaaatttcacaattctattctgataaaaacagaggcgaaatgtaaagtagcaacgggcttcctgggagaactctctcccacggttttaataggctggttaggatgtgctcgacagctacctggctggctggagacatgcttcccacaggctaaccaagtgcatacagtgaaggtggatggtggtgtctgttcatctcggaagagcccaggatcaaactatcactccctagtcaccctgtggtctctgccatgtttccacagatctctaaagttgcttaaccctgatttatgcagtgctgaacatctctttcagcgttagaactgaatattaccacctctgatgatttctcaaggaagcagtagatatgacagtaactgtcattgagatggtgaggcaaaggtgggggtgaggagtgtgggaagaaaattccatggtcctcactggctggggaatagtggctgcagtgaccacctgtctgtggctacccaaaagcacaagtgagatttgagcatcctctctcagtggtttttcatggccagtatttctccaaccttaatgcccatagaaaccatctgagggtcttgtgaaaagacagttctgattcagtaggcctggagcaggacccgagactgcatttctaataagctgctgaagctgctggtctgtagtccactgtgtgagaagcaaggctctagtccgcatagggctccaaccagcccgattcctgaaatttggaggagcccaatgggaggcagaagcaagccttaggaaaagcaaagtccctccactgaatttcaaaagccaacatgaaagagacaaaatggactggcctcttcctgtcaaggcagaaatctcagcaatgaattctcagatgcaggcctcaagaggccttcttcagctggatgagttgactcattcctgtatctcagcactttgggaggccaaggcaggaggatcacttgagcccaagagtttgagaccaggctgagcaacacagggagaccccatttttctaccaaaaaaaattttttttaattagttgggcatagtggcatgtgcctgtggtcccagctagtcaggaggctgaggcaggaggatcccttgagcttaggaggtcaaggctgcaatgaactatgattgtgccactgcaccctagcctgggcaatagggcaagactctggaagcaaaaaaaaaaaaggccttcattgatcattgccaccagaagtttacctgccctgaggagtcaactttgaatccctcactgattttgcatatttgttttttattttattaatatctgttctcaccttcactgtttccttctttttatgttctttgggttgatttttattttattaatttcgttttttcttctatcctacctagtacagcgctttcatttaagactaaaattttttctcttaagttcatttaaaaatactttccaactgccattatgatttcttatttgacttgttggttatttagaatcataattctcatgttaaaatattaagggttttccagttatctttttgttatagacttctatcatagattatgatcagacagcacactctggaattatacggtcctttcaaatgtgttgagacttactctcaggtgcacaaggtgggaaatttctgtcaatgttccatgtgtgcatgaaaatattttatattctggagtattttactctatttcaatgattttaagacacatgcaaaatttgggacacattttataatcacagaggaacaaacgaccacctgtgacgttgtcattgcctgtgcacatatgaatgtctacatgtatggtgtatgacacagcaactgcaacctcttcaccttctagttgtcagatcgtttaaggaccatttgaggaagatatgtgagtcttagtagttgtctgaaaatgttccattgccacttttcaggtaggatcaagcatcagagtcttaaagtcagtattaccggtttgggaaaaaaaccccatagacagtaacagagctctttcttagcaatgccgtgtttccaaccctcctgatgtcaaagaggatgagaatgtttggaaaaacatgaacattgatggctctgagtcttgaagaaatcccaaagcaaataattctcaaagacatttcagaaatagctaatacaatttatttctcttatattcccctttaaaaatatgcacaagaacaacataattaaatataaaggagcttcctcaatcagtgtggtctaacaatgtcaagtgatgagaaatcattgtgtctcagttaacatggttctcttttttcttagtgcctcataaaataatagtgtgtcttccagtcaaggacttcttagattcaaggaactatgtcatatctgtctgtaggtcaagtttgtggatcatgttgattaaatattctttcctctggattttttggttgtcattattctgtcaattaccgcaaaatatatagtaaaatctcctactgtggttgtgaattactgtggctctatgaggttatgtggttctatcaatttttgctttaagtattttgaggctgcgggtccagttacgtagtgattctcattgtctctaattgtgtgtttttccctcaaagtatacattgtatttgcctggtattagtacagctataccaattttattttgtttaatgataactggatttcttttttcatcctttatttcaacccttctgtctccttagatttacaatatatctgtcattttgttccacctgttctgggttcttttccattgttttcttatctcattcatattgaaagagtcttttgttaggctgggcatggtggctcacgcctgtaatcccagcacttttggagaccaaggcgggaggatcacctgaggtcaggagttcaataccagcctggccaacatggcgaaaacctgtctctactaaaaatacaaaaattacctgggcgtggtggcacctgtaatctcagctactcaggaggctgaggcagggagaattgcttgaacccgggaggctgaggttgcagtgagcgaagatcgctccactgcactccagcctgggtgacagagcaagactctgtctaaaaaacgaaaagaatcttttgttttattttgccatcacgtaatacatctatgtaaaacaatctttttatttcgtttttctctgttttagtttgaaagttatacactctttttctcttctattaatggttattttggaaatgacagaatacatcttggacttacctagatctaatatcaactgttactctttcccttctcccagccagtgcaagaagcccaggacatttatctccatttatcccctccattcttttttttaaagttctggggtacatgtgcaggatgtataggtttgttatataggtaaatgtgtgccatggtggtttgctgcacctatcaacccatcacctaggtattaaacctgtcatgcattagctatttttcctgatgctctgccccccaacaggccctgtgtgtgttgttccgctcaacatcactgatcattagaggattgcaagtcaaaaccacaatgagataccttctcacaccagtcagaatggcgatcattagaaagtcaagaaacaacagatgctggtgaagttgcagagaaataggaacacttttacaatgttgttaggagtgtaaattagttcaaccattgtggaaggcagtgtggcgattcctcaaagatttagaaccagaaataccatttgacccaacaatcccattactgggtatctacccaaaggaatatacatcattctattataaagatacatgcacatgtatgttcactgcaacactgttcacaatagcaaagacatagaatcaacccaaatgcccatcagtgatagactggataaagaaaatgtggtacatatgcacaatggaatactatgcagccataaaaaaggaacaagatcatgttcaaaaatataggcactgcggtgagacccacataggctggggtggatcagcccctgcctacctggcaatgaagacccaatgactcgtggtaggtagagcacagacagcgctgcataggaaatggtgcaggcattaaagcttccattggtggtgtcctggagagaggaagtgcattaactcgtgtgatatgccaagggtttgggaaaagtgggggaaatactaaccataacgaaaaggggattggttggctattgctaaacttgattgacctttgggaaagaaaataaaaaagctgggataatcaattagcaactaacagctaagaatgaatgcagaagccttctttggtcatgaatagagaaattctcacctcctgcactgaaaaggaagggagggttgagtgccagggtcagacctcccttgagagtggcagagctccaaatgaggtggattcccaccaaggtgacactgttatgtcaaggtgaggccatggctgggaaagaacgggacccagcatagaggatggggacatctggattaatgcttcctaaaatatcaaatctccagattcccctgaacctctgagcttgcacacaggaacctcggtcctgcctaccctttgttgaagatgacttagggtcctctcctcccgatacctgtgccttcctcaggatctgcctctacctcccttcctggataccagaccagtaagtaggttaaatcacaacacaaaccagcctggaactgttgggcctgaaaggggaggaaggcaactgtaccctaaagaaaccagaggatctagcagcagatgctgcctggagctataagaatgcacctatataaggaattggagggtgcttggtcaagggagccagagcagaaggttgaataagagacggttatttgagttagttatttccccaataactctctttttatgtctaatctcttggcatctgcttcttagaagacccaaactcaacacagaactgcgtcaaagttccacttcttcctctgccacccatgctggtcccctccccttccatggttgttaatcccaagagcactcctcctaagtcttgaagctcatctccatcctgggtctatttcctggggagccagcatcggacggctgcactgcaaaggcctttgtttctgtactgtctggactgtctccatcctgctttctcattctttcctaagctttcacagcttactttaaatcttcttctgttatattattgtctcttctttgatgtcttacagatctcctctgagttcttacttcactgtgattatgcttcctttgatttccgtgagttcatggagaaatgttaattcacattttcttttacttctgatgtatattattcctctgtctttgtttgttgtcattgttctctttttggggaattattgttcatgttaatgaggatttgctaagagctgtgtggggaagggacagattgaggtggggcggtctcctgaactcaggggttctggaaggactttctcatggatgcagtgtcctctgtgcaaggacccagtgtctgctcactaatctcaatgggccattccaaggaaagcaggcccatgtggtttgtagcaaagcctggatgttcgagtatatttggggtaatagagcagctcatactaagctgactgccacatgctttgcagaaattctaggcatcttgatgatctcccccccgcctggctcatccaaaatgccaggtgtggacaccctagccaggacccttgattgcaccccttagggctgtgctacccttttatgggaaactgtcagctggaaatgacctgtggggttgcatatgcttcttggtgttatgtcccagtgtgatccaaaatgtattgtcttttgcagttattatttttaacctatggttttgcatgtattttcaaggaaattggtttcttctctattgctcattctttttgtcattttcagttggccattggggaaggaagtgaatctggattagaattctaaaataattttttttttctttgagacaggatctcactctgtcacccaggctagagtgcagtggtgcattcttggctcactgcaacctctgcatccagggctcaagcaatcctccaacctcagtctccaaagtagctggaaccaaaagtgtgcaccaccatgctgggctaattttttttttttttttgtatttttggtagagacaagttttcgccacattgtccaagctggtcttgaactcctgagctcaagtgatccactcgcctcggcctcccaaagtgctggaattacaggtatgagccaccgtgcccagcctacatcttattcttttaaaaaaatccaatttaacaccttaaccacatagctgtatatttaaaatatgttaattagtaagatattagcaacccaaatcacaagagatacagaataaagagaaaggtactgaaagcatgaaaaaaaggtacttaaagcatttaaacacagacatcattttttaaatcatgagttagaaaattagatatgaaaaagaaaaaaaggttagtttgggattgcttcagagacacaaaactagttaaaaacacactggtcccagctatgttcatagtgttctccattgctcataaaaactgccttcaagaagtggtgatgatgtagttctgggggagaagcagccgatgcaatggtaagcagactcccccacgtatgaagtcatctgcattgcgtggctggatgaacatctgccacataaactctgcgttggttgcagtgtgccacaaaaacattctttgtttctctctgaccccagctctcattttgtgaggtgaagattggttgacataatgagaactttctgaagtcatttcactgaggacatttaatacaacttctttgcaagcgatgtcatagacttcagtgtctttgtctggcatgtgctgttgctgcaacatgattcacagtggatggcgggggaggagctgcaggcggcagagagtaatcaagcactcatttacgcgcctccttcctttcgtcttatcaagcagctaaatgccagctcagaatcagcccacgccacagtcgttttctggactttcactattaaaatgtccacttacataggaagaaaaaagacagtgactcaaatcagactcaatgcctggtttataaattaagaaacagctattttggccccccaaaagaaaactacttctcttttctcttttttcagaaatgcaaactatgagttttatgaaaactacaatttcattttatgaaagggtagtcaattccattacgtctttcaaacccattggcaaaacgtgtaaaaagaattggggttaaagtgggaaaaatcttacccagttctggattttaaagcaatcacaaattagtacaatgtgaactaaagaagagcccaaagcttttggttctaaggaattagagaatctttctgtttccactaaagtgaaagcatgttccaatgatgaacctccagctgcataggtgacagtctttccttattcaatccctgaatttaccttacatagtaggtggacggccacccaaagatatcaggtcctagtccctggaaccagtaaatgttaccttataaagaaaaagggtcttggcagatgtggttaagaatcttgacatgaggaggttatcctggattatctggatgggctgtaaatgccatcacaagtgtcggtaaaagacggggagatgacacacgcagaagagaaggccatgtgaagacagaggtggagactgcagtgatctggccacaagcaaaggaatgcaagcagcactgcaaattggcagggaaaccttgatttcagcctactgaaactgatactgaacttctgacctcctgaactgtgagagaatacatttctgtttttttttgttttttttttttgaaatggagcttcactctgtcacccaggctggagtgcagtggcgcaatctcagctcactgcaacctctgcctccccagttcaagtgattctcctgcctcagcctcctgagtagctgggattacagatgcccgccaccatgctgggctaatttttgtatttttagtagagaccgatttcaccatgttggccaggctggtcttgaactcctgacctcaagtgatcagccagcctcagcctcccgaagtgctgggattacaggcatgagccaccgtgcccagcccatttctgttgccttaagccaccaggtttgtggtaatttgccatggtaacagcaggacattaatacacctatttctatggaaatatggcatggctttattcaatcctctcttatcacttaattaaatcatggatatcccaaaaattgaagtataaaacttaaatcaagtatttcctagaatttgccgatttaacgttgaaaattttcttttgccaagtgcatgtaaaaaccagcctgggatgatattgtgccagtgtcagtttcctggtttgatcatgtactcgagttatgcaagttgccgccattggaggacgctgggaaagtgtacccaggccttttctgttctgctttttgatcttcttatgagtctatactcatttcaaaataagaagttaaaataaaacccttttctttggcctgtcttttgtttcttcaccttttatattggacaatgattgattgctggtagcttcagagttgagctgtgaaaaatgaaacagttcatttgcttttcaagaaaaaattattcacaccagtggtttataaagtgctagaagatttcatattcaagtttcccagaaacaaaagtagagagtgaacagatagaggatgctggctgctgtgcaagcacgtgccaggcatggggcacaatgtgcccactctgcgctcttaccagctctgatagtgtggtggttaatcaggctgttgttcaaagctggaagctggtgaggaagaaggaagcaagtcccactgagaggtgaagccagctggacttcctgggtggagtggggacttggagatcttttctgtcttacaagaggattgtaaaatgcaccaatctgcactctgtaaaaatgcaccaatcagcgctctgtagctagctagaggtttgtaaaatgcaccaatcagcgttctgtaaaatggaccaatcagcactctgtaaaatggaccaatcagcactgtgtaaaatggacaagtcagcaggacatgggcagggacaaataagggaataaaagctggccaccccagccagcagcaaccagctgcgggaccgttcagttcctcttccactggttgtggaagctttgttcttttgctcttcacaataaatcttgctgctgctcactctttgggtctgtgccatctttaaaagctgtaacacttactatgaaggtccacggctgagaccatgaacccaccaggaaggaaccaactccggaccaccacttcaaggtgtccaggccttcctgtctaggatgacaagcgcccttcctgggagtgacagtgaaaaggcctagggagatgatcatcagagccttcagggggagaggtgtttctttcctacaccagatactagctagataacaaaagaaattctagtactgccagttcccaagagcacaataaatcaaacagtggtattcctgaactttacaggggtcaggtatacatgaaaataatttattgtcccttttctttttgccttccaactttgcctgtgttcatccaagaagcccagtgtctgtgtgaccccttagaatttagacagacagacgtatttggagagatccttgcatcctaggcaccaggtgccattaagtaactcaatgtttcttttcatggtacattttcagttactatgttcattcattcaacaagtatttgccatattccaggcacagttttgggttttcagcacctgggatacatcagtgaacaaaactgacaaagaatcctgccctttggagcatatattcaagtagagagaaacaaacaaaaatagtaagcttaagaaataagaattacagtttaatacaagatagaaagagaagggaatattgaaaagacaagatttgaacagactttaaagatggtgaatgagtgaatgtgagtatctaggaggcacagggcaaatagaaaagccagcggaatggcctgcagaagggagcgtgttcaagaaagagcagagactcaggatctgaagcctgcgagaggggatgggatcctttgcgtaagtggaaaaactggttctaggtagaagcactagttctcaagctttaaggcacatcagaaaaacatggggggcttgttaaagtacagattcctgggggcagcgcttccacagtgctggggtcaggagcttagcaagtcctttctctgagaagaaacaatgcaactgaaaaaaaattatttaaaaaaacccaccatttcaagactctaagaatcaaccaaaggcattccacaaattaagaaaggttgagtgagaaaactgcgggatctcaggtagttgtggctcttttttgggggctggttccacccccactgcctgctctgtcagtgaagtatttcatcagggaatgaaaaccataagctttgctaccagagggtgataacttgatttggagtggagagtaggaagaactccattctcctggatgttattggaaacaatagtaagcccagtggcaaaggaacagggaagaagaacactgcagtcagcccgaggcttgattccggtagagaccagctgacctgcaggctagccagaaatttaaccaggaaatcaagggaatgagacagccatagtggaccttggtaagctcccacatttctgtcggtttaaggctgtgcatacgtgcaaggctgtgtgcacattcagaagagaccagagaggaccccagcaatccacacatctctggcttaacctgaggctatacatacccagaaagaggtacaacagggctgggtgaaaagtaagagccgggacaaattgataaatgagctgaactttaaatgagtttcccagccacaaacagagctattggcacagaaaagaagccttagtcgtttaaggtgtttgatcataatccctgaccatcactggctaacttgtcaggcatactgatacaaagtgacccatggatgccagccatataagtgaaaagaataaaaatagaaggaaagaaggaagggaggaaggaaggaaggaaaaaaacaggagggagggaggaaggacagaaggaaggatggaaggaagaaaggaaagaaggagaaaggaaaggaagaaaagaaaggaagaaaggaaagaagaaagaaagggaaggaaggagaggaaggaagggagaaaagaaagaaagagaaagaaaggaaagaaagagaaacaaaagaaatagggacatcaacaaagatacaccacagaattagtttaggcaaattatcaaaacagacaagcaaaaaaagagtaacaacaacaacccttgaggtggcgtgggggagaatcaaaatttctataatatattatctaagatgtttagttttcaataaaaacttaggagacatactttaaaaagcaggaaagtgtgacttccatgcaggaaaatgagcaattcatagaaactgcctctaatgaggcccagatgctgaacttcacagacaaggaatgtgagaagctataaacagaaaaaatgggatcagagacccataaacagaaaaaatgaagagagcttcagagacccttgggacacaagaaatgcatgcacttgtgcgctctctctctttttcatttttattcttctaatttatatggctggctttctatgggtcactttgtatcagtataccttagttgttagccagtgatggtcaggggttatgatcaaacaccttaaatgagtaaggcttcctttctttgccaataggtctgtctgtgggctagggaactcatttcaagttctgctcatttacaaatttgtcctggctcttactttccacccaaccctctcatgtcccttcttgagtgtaatggaactccctagaaagagaggagagagagaaaggggaagaaaaaatatttgaagaaagaccaaaaaaattccaaaattggaatttaaaaagtataatctacagattcaagaagctcaactccaagtagaatgaacacaaagagactcatacctaaatatttcatggtcagactattgaaagacccaaaaatgtcttgaaagcaacaagagaaaaatgattaatcataaaaagctgactcaaataataaaggtcacaaggcagtggaacagtatacttaaaatgctgaaagaaagaaggaaaaaaaccccacctattaagaagtcaatatccagaaaaattgtccttaaaaattaaggcaaaataaagtcactcccaaatgatcaaaggctaagagaattcatcactagcaatcgtgtcttacaagaaatattaaagaatccttcaggctgaaagggaataacactagacaataactaaaatccacaaacacaaaaaaaaagcatggggaaaggtaaatatattggaggtgtgacaggcaataaatatttttctcttttctcttgtgtaatttaaaatgtgtaagattgtataaaactataattataaaaccatattgtcgagcttatagaaaaatgtcatttgtatgacaataccacaaagaaattatattggagcaaagtttattttatgaatggatatgactctggagtagattgtaattagttaagatacatgttgcaaaattgagaacatcctcaaagaaaataatttaacaaaaaagaaaaataaatgatacactagaaaatatcaatctaacaaaaaagaagacagtaaaagaggaagcaaaaaagagaaatgacctgagccatatagaaaacaaatggaaaaaattgaagacataattttaattacactaaaaattacattaaatgtgaatgatttaaatagtccaatcaaaagacagagattatcagactacatttaaaaaaatacaaagtccaactctatattgtttacaagagatataccatagattcaaaaatacagtttcagagtaaaacagtggaaaagacacatcatgcaaacagtaaaatataagagagccagagtagctatactaagacaagattgattttaagaaaaaagcgttattcgagacaacaaggaaaatttcataataataaaaaggtcaaggtaccagaaagagacacttttaacaagagttacaaaatatgtgatgtaaaacctgacaaaatttaaagaaaaaaattaatgtttcaacatagtccaagattttaataatcctatctcagtaattgacttaaaactatatatgaaatcagcaatgatatagaagacttcaatagtactatcaaccaacttgtcataactggcatgtatagaacacttcatccaacaacatcagaatacacattttttcaagtgtgtatggaccttctccaagacacactatgctaggccataaaatgaatgtcaataaatttaaaagacttgaaataatgtacagtatgttctccagccacaagacattaaattagaaatcaagaacgaaaagaaatttggaaaatcccccaatatttggattaaatagtgcatttctaaaataactgtgggtcaaaaaagaaatcacaggggatattagaaaatattttcaatgaaaatggaaacacataaatatgtgaagatctatgggattcaaataaagcagagattagagtgtaattcattgttttaagaacctatataacaaaagaagaaatatcttaataacctaagctaccaccttaagaaactaaaaaaagagcaaattaaatgcaaagctagcagaaaaacaaataataaagataacagtgaaatattgtatgattttatgtttgtgaaatgtcaagacaagagaggtaggaagtcgattagtgattacctagggtggaagggagggggtttgtgggcgttaacagtaaaagtacatgagggatctttttagagtgatgaaaatgtctaaaacagatttttaataatgatttactgtattagagctttccagagaaacagaaccccagggaaaatacagagacagaaatgcaaagtggggaagagattattataagaagttgactcatgtgattatggagacagagaagttccaagatctgccgttggcaagctagagagttaatgatgtagttctggtccaagtctgagggcttgagaaccaggaagactactggtatacattatagcctgaaagcatgcaggctcaagacacaagaagagataatgtttcagtttgagcccaaaggcaggaaaagatgaatgttacagctcagtcagacaggcagcagttctcttttactcagcctttttattctgctcaggtcttcaattgattggatggggcccacacacattagggttgcaatccactttactcagcctactgcctaaaatgttaattaaaaaaaaatcccactctcttggacacatccagaataatgtttgacaaaatgacttggcacctcatagtccagtcaagttgacacataaaattaaccaaaataaggatgcctgcttctcccacttctattcaacataaatattaaagttctagttaaaccatttaggcaagaaaaaggaatcacaattgcacaactcagtaaaagtactaaaacccattgaattgtacacctgaaatttgtgatttatataatgtgcctcaacaaagttattagtacagtaaagagttagttctttggaaaaatcaaataaatttacaaatttgcaagattgacaagggaaaaagagagaagacacaaattaccaaaatcaggaatgaaagatggggcacttttttctactgtgataggctgaataatgccccaccatcaagatatctacatcccctgtaatctcagcacttttggaggccaaggctggcagatcacttgaggtcaggagtttgagaccaacctgtccaaaatggtgaaaccctgtctctactaaaaatgcaaaaattagctgggcatggtggtgggtgcctgtaatcccagctacttgggaggctgaggcaggagaatcgcttgaacctgggaggcagaggttgcagtgagccaagattgcaccactgcactccagcctgggtgacagagtgagactccatctcaaaaaaaaaaaaaaatctacatcctaatcactaaaatctgtgaacattatctttatggcaaaagaggatatgtagatataattaaattaagaatcttgagattagaaaattatcttgaattatataggtgggccctaaatgtagtcacaagtgaccttatcatgaaggaggcaagaaggtcaaagatggaagaaggaaattgaagcaaaagattgaagtgacaccctttgattatggaggaagggattacaaaccaagagatacaagtagcttctagaaattagaaaaggaaaggtaatggattctcccttggagccgccacaagaaatactggccttctgacaccttcattttatatttctgacctttagaactgtaagaaaataaatttgtgttgttgtaagccaccaagtttatagtaatttgttatagcaacagtaggagactaaaatactcatcctagaaaaatcgggatcataaggtaatagtatatgctattttttgctaaaatttggacaacttagatgaaagccacaaatgaccaagactgactcaagaaaagatagtaaacgtaaataatttatagaagtaaaaacttgtgctagcaactgtgatattatgatacatatatgttggtttgcattcgtggttcctagtgcgtaactctcataacccttgttataatgtcagggtgcttttggcctcataagcagcctcagaaaacagaatcgctctctctgactttctcttgcccacctttcacctgcccctttttctcttcaaggcagaaaccttcccccacctttctgtcttggagctggccataaattctctgacctgccttctgattgtgggtcctaagacccccatcttaaaaggatactgccccatacccagaaggagggaatgttacacagcaaggtcaagaagaatctgaacagataggctttgtcaggttttctaattcagtccgttagtattatatcataccctttttgtccaatcacatttctacacagaagcagagaacttatttgcaattttctaatctatctgcaagctgttcaagggactggtttcagtctcacctgactcagagttcagataggaaaaagcagcatagctcagatctcatgcttgcaaaggccacacaaaacagtggcaggtgtcatggcatgtgaaagttgtaggggaatttgcagacctatggatgcctaatttctaagaaattagaagcagaagaatacaatggaatatctaacggacattgaaaaaaaggcacacacacacaccagcccagataggacacatgcccagaaaagaatttaagcctttactccaggcagataccaaggctcagaatgtgccctgctaatgaatgaaggtcttctctgccagtttgcaaatattgggagaagtggttgggttttcaattctcaaaaaaagatcacaaggcatacaaaaaaaaaagaaaaccataacttattcaaagaaccaaaataaatctccaagaatgatccctgatgaaacacatattggatttactagacaaagactttaaaacatctgtcttaaatatggccataaagctaaatgaaagtatggataaagaactaaaagaactcaggaaaatgatatataaacaaaataagaatatcaataaagagatagaaattattttaaaaaccaacagaaattttagagctaaaaatacagcataacactggcaccaaaggcaaagatgttacagaaaaagagaagaatatagatttatatcctttatgaatattgatgcaaagacgttcaacaaatactcacaaattgaatttaacaatatatcaaaagattatacatgatgatcaaatgagatttattcctggaatgcatggctaattcaacatacaaaaaaacaataaatgtaatacaccacattaacaaaataaaggattaaaaaaagaccatttcaaatactgcagaaaaagcatttgacaaaattcaacactcttgcatggtaaaaacagtcaacaaactaggaatacaaataatgtacaacaaaatataggtgatatatgaaaattctatagataacatcatatgtagatgaaagaattaaattttttcatttaagacaatgaacaaaataaggatgcctgcttcttccacctctactcaacatgaagttctagttagaccatttaggaaagaaaaaggaatagaagatattcaaattggaaggaaagaaataaaattatccctgttcacagacaatatgaacttatatgtagaaaaccctaaagattttatacacacagacaaaaatgctataatagaattaataaattcagcaaagctgcaagacacaaaaccaacatgcaaaaatcatttgtgtttctgtacactaacattgatcaatctgacagggaaatttaaaaaaaagaactccatttaaaatagcatcaaaaagaaaaacaacacttagaggaatagacttaaccaaagatgtgaaaggcttgtacattgaaaactacaaaatgttgctgaaaggaataaaagaaaacacaaaaaatgaaaagacatcctgtattcatggatggaaaggcttaatatcgttaagatgtcaatgctacccaaagtgatctacagattcaattcaattcctatcaaaatcccaacaaaattttttgcatacatagaatagtccattctaaaatttacatgtaatctttattagccaaatagctacaataatattgaaaagggagaaaaaatgttgaaagtctcatacttttttatttcaaaacttaccacaaagctatagtaatcaatgtgatactgtcaaaacccagtcacataaaccaatggaatcaaatagagggtccagaaataaaccctcatgtgtatactttggcaaggatgctaagaccatgcaatagggaaaagataggattttcaacaaatggtcctgggaaactggatattcacatgcaaggaattaagttgaacccttaccttacgccatctacagaaattaacccaaaatggaatagagacctaaacataaaactaaactagaaaacttactgggaaaaaacctgcatgacattgcatttggaaataatttcttggatatgacatcaaagcaaagcaataaaaaacagattaattgcatttcatcaaaattaaaaacttttgtgcatcaaagaacacatcaacaaagtgtaaagacaaccgacagaatggggaaaaatatttgcaaatcatttatctgataaggaattgatatgcagaatatataaagaactcctacaatgcaacaacaaaaagacaaacaagtcaggaatggtggcacatgtctgtagtcctagctacttgggaggctgagatgagaggattgtttgatcccaggagttcaagaccaggctgggcaacacagtgaaatcctatccttaaaaaaagacaaattacccaatatggaaaagagcttgaataaacatttttcccaaaaagatattctaatggccaataagcatatgaaaagaaaaccacaatgagatgccatttgtcacctattaggatggccactataaaaaacaagagaaaatatcaagtgttggtaaggatgtggggaaattgaaaccctgtggagaaagcgtggcagttcctcaaaaattaaacacagtatcaacacatgatccagtaattccacttctaggtgcgtacttaaagaaactaaaagtgaggactcaagcagatatttgtacgcacatgtttatagcagcattgtccacaatagccaagggtggaagtgacccaggtgtttattgacagatgaatggatagaccaaaagtagtctatccatacagggaatgttattcagccttataaaggaaggaaatcctgacacatgctacaacacagatgaaacttgaggacattgagctaagtgaataagccagtcacgaaaggacaaatagtgtgattctgtatatacatggtacctcgattagtctgattcattgagacagaaagtagaatggtggttgctggggctcggggagaagggaaatgtggtttaatgggtatgaaatttcattttgggaagacgaaatgttttgggaatggatggtggtagtggttggacaaccacgtgaatgtacttaatgccacaggaatgtacacataaaattggctaaaacggtaaattttatgttatctatattttaccacgatttttttaaaaaagagaaaaaaagctttccacaaaaacatactccagaatcagatgactttgcaggtgaattctatcaaatcatatcagtccttcacaaactctgagaaaagagaagagaaatttattgtaggaggccagcattatcccagtgacagagctagacaaacacatcacaagaaaagaaacgtacagaacaaaacccccagtaaagagagacagcaaacttcacagcgaaatattagcaacctagctgcacataaaaagtattatttaccatgaccagataagattatcccataagttctttaccctggaatcaggaacaggataaggatgtccactttaccagtgctattcaacttagtactggaagttccagccaggataataaggctaaaacaaaacaaaaacagaagatggaagttaaagatatccagattggccgggcgcagtggctcgtgcctgtaatcccaacactttgggaggccgaggcgggtggatcatttgaggtcaggagtttgagaccagcctgaccaacatagtgaaaccctgtctctactgaaaatacaaaaattagccgctcatggtggcgcatgcctgtgatcccagctactcaggaggctgaggcatagaatctcttgaacccgggaggcggaagttgcagtgagccgagatcacgccattgcactcccatgtgggtggatgacagaagaggtctccgtctcaaaaataaaaataaaaagagttcttgctctattcatgagggatagtggtaaggaagattacttgaatatgtagactttgattctgggggtcctgaaccaaagatcacaactggtgaaaaaaaaaaaaaaacacccaagacttctaaatctgaggatgtcactgtgattgaacatattgtttggtatgatgtataacagtgcatcaaagccagtgaagaaaggagcaaatagaattggtaaaagttcataatacagcaagcctaacaagaaacagttaatttgggaatctcagcttaaacttttgaccttttgaagagaagaaatgttcgtgccatatcactcactgtctggtagcccctgtgccattgaccctaccttggagagtttgtgtgaaataaaatgagattccctttgctctgccccactgtgagtcaccagggtgccttggaagtggcagagtctggttggagcaggtgaagtgagagtgagtctggaacacactgctgttgtcggaaagcaaagatgccaccacagccagacctagggggtgtgaaaatggaaaaatagtgaccatcctgacaacagggtcccagtagtaatgacttgaacattaacaaggaagcaaagattttggcccattggaatcagttgagtgtgtggaaggccacagttcttgctatggtgggaaaagggcaaatcacatccactgtgccggagcagaggctctcctgctagtgtgttcgtgcatcaatgcctgggtttcttccccagtgtcaaaaagggacaaatcttaccactgcttttcgcctttttaagaaaagtgaaacgatttgttgaattcagtgcttctcaaagtgtggttcattgatccctggggttccacaaggtcaaatatttttataataataataagatgtgatttgtttttctcagtctcatcctttggtgagtgtacagtaaagatttccagaggccacatgacctgtgatatcacaacagattaaatgcaggagtagatacgaaaattccactctgtgtgtactatgcagacatttaaaagtttcacaaaactgtaaactaatgccactctgtctggaattttttttttttttttttttttgacggagtctcactctgtcacccaggctggagtgcagtggtgtgatcttggctcactgcaacttctgcctcctgggttcaagtgattctcctgccttagtctcctgagtagctgggattacaggcacccaccaccacacctggctgatttttttttttttttttttttgtatttttagtagagacggtgttttgccatgttggccaggctggtcttgaacccctgacctcaggtgatccatccgccttggcctcccaaagtgttacaggagtgagccacagcacccagcctggaattttttttaacttaaaatatgttattttttaacttaaaatatgttatttgtgttagcaaacaatgggtttatatattattattaaataaatcaagtgcatatcttttattgtctccgttttaatttctagtacagtaactatcagtaaacaaacaataaacaaaggtttttggaggccctcaatagttcttaagatcataaagggatcctgagaccaaaaactgtgagaaacactggtttgctccactttcttcttcttgcctttcaagttcacatatttattgcagtgggaggcacgggcatttgttgtttctgtcttctatgcaagaaatgccttaaaagaaagaaaggaaaatcagccccactttagaatggcctgcagcccctttggagggctggggaggggtgttccatgcatctggaaaatgcaaggacctgtaagaactaaggaatgctctacagtcattgggcacactcacagctcatctccagaaaagcatgggggtctagggggacatgactgcccccagaacaccaagggtgggtgaggggcttcacaaagcactgatggaatccttcctccaaccagatgaccacatcatctatctgggagccttcatggggacttggggtcaggctgcagggctctctgctctaaatggacactacacgtacattttgcttacatttaagggagctcgcatgcctccccagtgtctgttcaactcttctcgtccatcataacacctttcaataaccacagagattgacaagctctatcacagagcaattacaaaccacaacagaacgttgtcagaaatggacatgacttttatcagcaggcagtcttctgacagaacttacttaaccctctcctttaaagggtctcttgaaatctctgggttcctccctcccgaaagtgagaaaagcctgtcagataaggaaattttcaggaatgccttatttaaacaacagcgccactgacagaagtgttacacaacaactaacaatagatggtatttgaaaagaaaaagtgctccagagaagatcaggcaaactagtaaacatctgcaggaagtgaattctcctccccagttgtagagactcatcttgctgtcagagaagagagaggtaagatttagcagtgttagataagggaaggtataggaagtccaaaattgtaaccttcaaactattttggattctgagaacaagatagtactcaacataattaaaattttcggaaacttaaagtgggccaaggaaaagcaattgattgcttacagtgcacaccatgaatccacaaaactgaaatttacccccagaaatagataccaataagagccattggctaacagtcctgctcaatggcatagatcttctaagagtgacagcatatggggaggtcacttttaatgtttcccaagtctttcgaaatctgtggcaagatgttttattaggaattgggtgtagcctaaccagacattcgggagagccctcatcaggcagagagaaagcatatatagggtggggtctgtaaggtgggggggtctgggagggtgggagtgtgggagcctcttgtgctcatgtgctttctttgctgcttagtgtgcaatatttatttacttatttttatttttatcttttttgagacaaagtctggctctcttgcccaggcttgagcacagtgatatgatgtccactcactgcaacctccatctcccaggctcaagtgatcatcctgcctcagcctcttgagtagctgggactacaggtgtgcaccaccatgcctagctaatttttgtatttttggtaaagacagggttttgccatgttgttcctgggctcaagcgatgcacctgccctgttcttgggcttaaacaatgcacctgcccctgcctcccaaagagctaggattacacacgtgagccaccgcacctggctgctgatacccaatattagcatggtgtttggcatgcaacaggtgctcagtagacacttcatgaatgagtgaggatggtgttattgcattggatcttaccctaaaaagaaagaaatggaaatcagggaacagctatgagaaggagattggggaggaagaaggatacatttagcaacattttattacttttccaggatcaacacaccctggaggtgctctctcactgtctgggatgttctacgcccttggggtttaggccctgtggctactttctcagtcttctttggtgctctgggaaagttttgtaaaggacttacttttatctctctcttttaaattgttctctttaaatgttttgaaaagcaaaaagtactagaagtgggcttgaaaggaacttaatgccagctaatggacaactcagtcaaattagatgaagattgtgttacagagctgagaagaggtagtcagatggcggaaacaatctcctcctgattggggaaaagaaatcagggcatgtgcatgcagtgtgtccgtcttccggtttctatttatgaatcatacctacttcatcatctctgtggggaataaatgagataaataaaaagtgcttagtgtgcaatatattcttagtgaatattagtgcctctccttccttccttgatttgaagaagggagtggagtcctcatatgcttttcacattttattttaatagactttattttgtagcacagtgttaggttgaaggaaaaattgcacagaaaagtacaaagagttcctatatacctcctctcccacatccacactccctgttattaacatagtgccttagtgtggtacatttattacaactgatgaaccgatattgatacattatggttaagtaaagtccacagactacattagcattcactcttcctgttgtacattctacaggttttgccaagtgcataatgtcatgtatccatcattacagtatcagaaggaatagcttcactgccctaaagaccccctgcactccgcctagtcatccctccctccccttgaacctctggcaacctctgaccttttaactgtctataattttgccatttccagaatgtcatgtagttggaattataccgaatgcagcctttttagactggtttcttttacttagcaatatgtatttacagttcctccatgaatatttgtgacttgatagctcatttctctttatacctgagtaataatctatgagtccattatatggacttatatgcatttttaataccaattatctactgtcatcttaagcactggagttgaggtagaatgcatagctttaagcactatggctagggaaaatctgacctctccaagaggcaatatacatgtagttgttaaaaacattgcttttgctgttaaacatacctgagtgtagcaatattcaacatccgaaaagtatgtattgaacatggtgtataaccagtgttgcgtctgacactcccggccctgcagatagagtgggagcaacacagacacagtccctgtgttgctgtcccgctggccctgcctcccaccccacagatgttctgtctgtttcacacccgcctgtacttactctgcaccaggaactgtctgacatgcctcataaatactgactcatttaatcctcaaaacgaccttatgagtcagtcccattattagtgccattttacagatacggaaactgaggcacagaatattaagttacttgctctccattcccctactactaagcagcaggggtgggattcagactcaggcagtgtggctttagagtctccttcctaacaatggaactatgctgccttgagcggaaggccaacacgagggtggagaattaggtaggcgatagcaacacagcgtgtttggcccacgcttcacctggttgtcattgcagaggggcgaggggagtggtcaggaaaaactagctgggcgaagcagcactgtcgtgtgctctgaaatacattaaagcctgatgggcatttcctaaagtgtgaatgagactcaattcttgacttctccgtgcctcgtgtccccccggtaatgagagcagccgccttacaggttgtgaggtctgagtgagaaataaacggtgccatgggaagacagccacactcgctagctgtgatgaggagcgtaaggaccaggtcctgacttcctgcaggctctcacttggcccttgtctgagtccttgggctggtgtccactgctggggaagaaggcagagtaggggaaagaaggaagctcagaaacaaggtacagggggctgcctgcagactacttaagagcatcagtttgcttcttaaactgatacactggctctgaagtcagtgccagaagagctccagaatggtttctagtggtggtatcctaaacacacacacttccagggggcagttttgatgcagaaccctcatttggactttttcttttttttttttttttttttttaagcaaacctctctttgctttataccagattgcatagacagccttttagaaatcactcagaaaatgtgtcttcctccagtcactgtagttcaccataataatgtgaaatgtaggacctgtggattgactttatgagtccaggacctatgttagcactgcattcctttgagtctggtcatcttcaagccaaagccagtaacagtgcaggcttgctcacccacctgagcctgcagctggtcctgagctttctcccaacaatcccctcagatctgtgtctgaaaatgcatctgtaacagtgatggcattccctcatcatatgacactttgtattttatttgtataaaataaagccagagttactgtattaggcagggttctccaaagaactagaaccaatggagatatataaatatatgtatgtgtgtatatatgtgaatttatatctgtgtgtgtatatatatattatattatatacaatacctgatgtcacaccattcagaattcagtaaatgtgttaacttttgtcactcctataaagtcaggcattgggtcctaaacatgtattagaacatgtcaattacctttttgtgttatgctctgtattaacagcctgaaccaaggagcgctataaaggctttgctttcccctcattagtggctgactttgcacgttatttctcatctggacattggattctgcaagtcctccatttatggtaaggaatggtagtttcgtttgtctggtttaggtagattttattgttgtttactttcagatttcataaaaatatgttactttcagatttcataaaatataaaaatttcagatttcataaaagtatgttaaaaatatactaaaaaatatttttggacatatgggcaaaggggcagacaaggatactttaacattaaagactttcttgggcctgatgtcttaaccgtcccagagggatctgtactgacccacctccactctcccaaacagtaattattcagaaaatataatcaatgcagattgtaaagattaaaaaacatgaatgatttaaactaagtattatttccctttggaggacacacatgcacacctgcacaagtgcatatgtgcacacacttcatcctatttaacaggaaaattgttggaagcctacttctttatggaagagctccattttgtattccttgttacctgtggagacaaacttaatacatgatttctaagatggtatattcaagagccattctctgtgacttttcaggctcagatttaatggctagtgatgtagtgaaagcctggggcagctcatgatgaggaccctcagtttctcagcatgaggctctatctcactggccactccactgtcagtaataaccaccatcgaaaattgaagtcccctagcaaaacacgcccattgctgttacttcattttgtctctgagacaaaggtctttaattggaggacaccctcagaagtgttgggcagtcacctggccttgatgcctttatcatcatggggaagcctgcactgaccacctccaatctcctgctaactccactccagcctaacaaagcagaagccgagagaagccctctgcgcagacacgcagcatctggggtgccaacttcacactctttcttgtcaaggccctggcactattcttactcttcctaaagaaagacttagtgtttcagaaggatgtacagcatgggttcagcccaagaaacacagtgagtggccatttaatcaaaaactaatataaatagcttaaagagtgaaaggattattccaataagggctgagtctatttttctataaggagtgaagccagggagctgaagcagcccagttactcacaaccacagaaatgacctatactgaagacactccactgagtcactgtttaaccacctaggcccctcggcaggaggggactctgctgacaagcctttggggtcagtcctgagacaacaccttgatatgtggcccagtgggtagcaaagaattctgaggtgttcaacattccccagttgaaaatgcattgaggggtagaagcactatggaaggccagggtcacaaagtgtgagtgctgaaggccgacttgtttatggtgtctgagtctcacattgctgctgtcctatgtaaacaaatgttagcagggccccatggaagtgagcaggcttacacgcctttgggaggggcatgcaccagcatgactcttcaggaggccagcttggcagtgtgtcttagaagccctttgacacagcgatttacgtggaagagtttatgagacacaaattgctgcatgatttatacaatagagtttgaaaagatgtgaaacacaggcatgatacaaataaattatgtacctctatccagtaaaacactctatagtcctaaaacattacatgctagaagaacatttaaggacagaaaaaaaattcaccatgtatagttaagtaaaaagtgtatgaaacagtatcaccctgattccattttaaattatttaaaatgccaaattaaagtttaaaaattaaaattaaaaagtgtctagatacatgattaacaagattttaaacaagtcccttgagatttcattcccttacccccagaacttgtgaacagggtgaggtatcactccatgattatgttatgctatatagcacagttgctcttaatacagaaagattctcctcgtgggcctgacataatcacatgagaccctttaaaagcagagaatctttcaggctgtttgaggaaaggaagccagagagatttgaagcatgagaagtggtcaatgcaccgctgttggtgtgaacctggaggaagcaggtgaggagggaatcagacaaccttaaagagctgagagatggggagctgacagttcgccaggatacgaggatctctgtcctgcagatgcaaggacttgaacttggtcaagaacccagtgatattggaagcagattcttccccagagcctccatggaagagcctagcctggccaacgcctcaatatcatcttgggagacactgcacagagaacccagtcaagccatgcagaacttcggatctacagaactgtgagctaataaatctgtattgcttaaagctacatatgtgtggtaatttgttacacagaaatgggatactaatgcaaaaaaaaaaaagcacagaaaagactaaaagatgagaatctaaaacaataatagcagccagtctcagtaatagaatgcttccattattgtggatcttatgtgatgggtatgggctctctttgaattcaggaaaaagacatattttaataagcagaaaaatgcataattatatctttacaaaagaaaaagataaaataatgtgtatggtattcattcagaaagggtagatttaaaaggagaaaaaacttctttctctaacttaccaattatatccagggattctttgtgttaaaagattttcttaattcaggaagttcacttaggaaaagtgagacagtttataagtgtgtcactttatatatggtcatttctttgtcccatacaggcactcaaaaattatttgcataatcctcctaggtgtacaactccagttacctgggaatctcatccccatcccccacagcagccgcagcaagaccggcccaaggagactctgagctcagacacgcctagccctgcccccatctgatggtccttctctacccaccctggtagcagaaaacaaaggacatataatcttgggatttctagggccctgcccactgccagtccctctccacactaccacagctgatgctttctggcaagtgccacctcctggcaggaggccaaccaacgcaaaaatagagcattaaaccaccaaatctaaggaccctcacagagtccattgcaccctccgtcacctccactggaataggcactagtatatacggctgagagacccataaatggttcacatcacagacaacccccagaaccagcttggagccaggtagactcactgggtggctagacccagaagagagacaataaacactatagtttggctcacaagaagccacatccataggaaaagtgggagagtactacatcaagggaacaccttgtggaacaaaaatatctgaacaacagccttcagccctagaccttccctctggtagagcctacccaaatgagaaagaactagaaaaccaaccctggtaatacgacaaaacaaggctcatcaacagcctcgaaaaatcatgctagttcaccagcaatggatccaaaccaagaagaaatccctgaattacctgaaaaagaattcagggggttagttattaacccaattagggaggaaccagagaaacgtgaagcccagtgtaaggaaatccaaaaaaatgatacaagaagcgatgggagaaatattcaatgaaatagacagtttaaaggaaaaaaaataaaatgtcaggaaactttggacacacttttagaaatgcaaaatgctctagaaagtctcagcaatagaattaaacaagtagaagaaagaaattcagagcttgaagaattaacccaatccaacaaagacaaagaaaaaagaataagaaaatatgaataaagcctccaagaagtctgggatgatgttaaacaacaaaacctaaggataatcaggttcatgaggaagaagacaattctaaaatcttggaaaacatattgtggggaataataaaggaaaacttccccagccttgctagagacctagacatgcaaatacaagaagcacaaagaaaacgtgggaaattcgttgcaaaaagatcttcacctaggcacattgtcatcaggttttccaaagttaagatgaaggaaagcatcttaagagctgtgagacagaagcaccaggtaacctataaaggaaaacctatcagattaacagcagatttctcaacagaaatgctaacagctagaagggattgggggcctatcttcagtctcctcaaacaaaacaattatcagccaagaattctgtatccggtgaaactaagcatcatatatgaaggaaagatacagtcattttctttccttcaacaaatgctgagagaattcactattaccaagccaccactacaagaactgctaaaagagctctaaatcttgaaacaaaccctggaaacacatcaaaacagaatctctttaaagtacaaatcacacaggacctataaaacaaaaatgcaagttaaaaaaacaaaaacaaaaaacaaaaaataaagagcatgatgaatgcaacagtacctcacgtttcaatactaacattgaatgtaaatggcctaaatgttccttttaaaaggtacagaactgcagaatggaaaagaactcaccaaccaactacctgctgtcttcaggagactcacctaacacataaggattcgcataaacttaaagtaaaggggtggaaaaagacatttcatgcaaatggacaccgaaagcaagcaggggtagctattcttatatcagacaaaacaagctttatagcaacagtggttaaaagagacaaaaaggagcattatataatggtaaaaggccttgtccaacaggaaaatatcacaatcctaagcatatatgcagctaacacaggagctcccaaatttataaaaccattactaatagacctaagaaatgagatagcacaccataatagtgcaggacttcaatactccactgacagcactagacagattatcaagacagaaagtcaacaaagaaacaacggatttaaactatacctgggaacaaatggacttaacagatatatacagaacatttcatccaacaactgcagaatacacattctattcaagagcgcatggaactttctccaagatagaccatgtgataggccataaaacgagcctcaataaatttaagaaaattgaaattatatcaagcactctctcagaccacagtggaataaaactggaaatcaactccataatgaactttcaaaaccacacaaacacatggaaattaaataaactgctcctgaatgagcaccgggttaaaaacgaaatcaagatggaaactaaaaaattctttgaactgaatgacaataatgacacaatttatcataacctctgggatacagctaaggcggtgctaagcggaaagctcacagccctaaatgcctacatcgaaaagtctgaaagagcacaaacaatctaaggtcacccctcaaggaactagagaaacaagaacaaaccaaacccaaaccagcagaaaaaaggaaataaccaagatcagagcagaactaaatgaaactgaaacaaacaaagaaaaatatataaaagataaatgaaaccaaaagctggttctttgacaagataaataaaattgatacaccatcagcaaaattaaccaagaaaagaagagagaaaatccagataacctcactaagaaacgaaacaggaaatattacaactgacaccactgaaatacaaaagatcactcaagcctactatgaacacctttacacgcataaaatagaaaacctagagagggatacattcctggagaaatacaaccctccttgattaaatcaggaagaattagataccctgaacagaccaacaacaaacagagagactgaaacagtaattttaaaattccctgcacgttctgcacatgtatcccagaacttaaagtataattaaaaaaacaaagcaacctattttgcaaagctgtaggatatactatcagtatataaaaatcacttgtgtttctatacagtagcaatgagcaaactgcaaataaaattagaaaagcaatttcatttacaatagcatcaaaaagaataaagtacccaggaatacatttaacagaagttgaaactttatttaaaaaaaaaattccaacaaaaaaagtcccagaccagatggattcacagcagaattctaccagatgttcaaagaagaattggtaccaatccttttgacactattccacaagatagagaaagaaggaaccttccctaattaattctatgaagccagcatcaccctaataccaaaaccaggaaaggacacaaccaaaagagaaaactacagactgatatttttgatgaacatggatgctaaaatccttaacaaaatactagctaaccgaatccaacaacacatcaaaaagataatccatcatgatcaaatggatttcataccaggaatacagggatggtttaacatacacaaggcaataaatgtgatacaccacataaacagaactaaaaacaaaaatcatacgattatctcaataaatgcagaaaaaaaatcgacaaaatccagcatccctttgtgattaagaccctcagcaaagtcagcatacaagggacataccttaatgtaataaaagccatctgtgacaaagccacagccaacataatactgaatggggaaaagttgaaggtatttcctctgagaacaggaacgagacaagaattcccactctcaccactcctcttcaacatagtactggaggatattacactaagtgaaataagccaagcacagcaagacaaataccacatgactcacttatatgtggagcataaaaaaagtcaaactcatagaaacagagagtaaaatggtggttaccagaggctggaaggtggcagaattggggagatgttggttaaaggacacaaaattagacaggaggaatattgtacaacgtggtgactcggattagtaacaatatatagtatattttaaaattactcaaagagtagattataagtgttctctccacaaaaaaaagtatgtaaggtaatgcatatgataaatagcttgatttagccattccacaatgtatacacatatcaaaacatatataggtataggaggcatgtatagatggtatatataggtatagagggcattgtacagtgtaaattgtaccttttatcattatcaaacgaccctgctcactgaatgctctttgccccacattaaatctttcctgatatttttattgccaccttgctttcttctgattttgtttccctagttgtttgcccatcttctgtcatctcaaatgtcctgtgccattttgtcatctgttatttgtttttatatgcagcttttacatgggttatgagtcaatctgaaaatcattttttccttttaataaagcagttcatcccttatttgatgttacggatgtgtttgcctttctctcttcacctcttattttcttatgtcttctgtgccgctgcttcattttaaaaatcttttgctgtttggcttctctttttgagtgtgtcaatattttcctttttataaagaagtagctttacaactcttcataatttacttaaaccttttttctttactgacaaactttaataatatctattgattccctgcaatgaaacaagcacttcctttgcctaatttttgttttaatattaatactataattctacaagtggctgttattatatcttttaacatgccttcccaattcaagatcacttccatgagccctagatttggccagccaactgtctacctaacatcactgctgggtggctaagtgcctccaacttgatgtgtcaaaaccaaatcatgattccagcctcccagacgctttcctttcacactttcccacatttcagtaaagagatgactcttttacctccttaccaggtcaaaaactgaggtgtcatcctcaattccttctttgtctttatccagcaaagttcaatccaacaagtcatgtcatttcttctccacagcacaattgattccattcacttctcaccctcatcactccagccccctcagtgtgacaccagcacgtcttcctggaggaggcaggagcctcattactaccccctagccctgcacacacactctaccctcaacattcattcattctacacatggagataacactactgtcctgctttacatccttcacagactccattgttcttaaactaacactccatttcttcctcaatgcctgcaaggcagggttctgcaatgggccagacattctagggcagcctctctgtatctctattgccctagcagggcttggtcatcctgtccagctctgaagccctttccactcagggctcatacacttgccctaaaaggttccttcccaggtccacacacgactgccacagctactccttcaggtcaagctcagacatcacctccccagagaggccattcttgacctggcatccactttctccaccacatctctacccttactatcattataacaaagaccaccaagttaccgatcttactgttggccaatttttggttgtcttctcccctcactagagtgcaagttccatggggacaactgcatgactgtctatcccaggctggaagctgtgacagactcagaaaagattttcaaatgaaggaatatacttaaacatatttatttatttatttatttatttatttatttttgagacagagttttgctcttgtccaggctggggtgcaatggcgtgatctgggctcaccacaacctctgcctcctggattcaaacgattctcctgcctcagcctcctgagtagctgggattacaggcatgtgccaccatggccagctaattttgtatttttagtagagatggggtttctccatgttggtcacgctggtcttgaactcccgacctcagatgatcagcccacctcagcctcccaaagtgctgggattacaggtgtgagccactgtgcccggcctaaacaccttttttgtttatcaaatttgggaagtatatagcaattccatatgatggcagtggagaaatttactcactttacaccttctccatcttctcattttcttagtcccttctcatttgtgtctccttgttgcttataatacagtacttaccttccattcgatacacacaatccccgtgctctgtgaattttatttatttgttttttaaattgaaaagtaggccaggcatggtggctcatgcctgtaatcccagcactttgggaggctgaggtgggtggatcatttgaggtcaggagtttgagaccagcctgacggacatggtgaaccccgtctctattaaaaatacaaaaaaaaaaaaaaatagccaggcatggtggcgcatgcctgtaatcccagctactcaggaggctgaggcaggagaatggcttgagcccaggagacagaggttgaagtgagctgagattgcgccactgcactccaacctcggcaacagagcgagacttcatctaaaaaaaaaaaagtaaacactatgtatatttagggtatacaaaatgatcatgaatctccacattccaaataatctattatcaaaatttataaagcaaaaactgaaggaaacacagggagacatggaaatacaacagccgtaggagacattaactcacttgtcagctactgacagatcaagtagagaaaaattcagtaagaacatagacagtggccttgaaaatgcaccgtgcaccggaattgtctgtgatgtgcctaaaactgccatccagaagcttctatgttagcaagtccggagcaacacccaggaatctgagctttcacatgctcctcaggtaattctaatgaacagaaaacatttcaaaataaaaaccatgaggagattctaaatgatgcacagaataaggtaaatctaataaatatatagtgaatgctatgcctggaataaaacagaatacagcttattttgaactgttcatgaaatacttactgattatagataaagccccaaatgaaacttcaaaaaaaattctataaagtagaaatagttcaggtaacattttcagattacactgtattaatgagaaataaaggaaaattaacaaacagaaaaacgcaaacatcaaaagacatttaactttctcttgtacaataagcagatctggccccaaagagggactcaaaatcaaatttgtgcaatacttacaaagtagtactttaaaaaaaagtatgtatcataatccataacacttggttagcttacactcagggaaaaattctaggccttaaacagttccactacaaaacaagaaagaatacaaataaatgaaagggaagagatgacatcttagttttgcaccatctcagagctatgagattggctgataatctgttcatatgcctgctgaccactgcttttcccctttcactttcttctgtttgtatcttttcttaaaggttggtagaaaatatttacgcagttttctccacctcaagttcatgaacattttttcttatactttaaataagttttatcataaaagactttaaaattcagagaagattagagaataaaacaatccaaatcccatacatccaccactcagttacaacacattttcatattttgccatgttgctcgtttttgccattttaatcaagttttactataaaatactttaaaattcgataaatttaaggaataatataataaatacccacatacccaccacccagtttttacacaccctaatattttgcctttttttgcctatttttttttttaagtattaaagtatcacctgtgggcattcagagggcttatggtggcagtaggaattttgttttgttttgttttgtgacggagtctcgctctatcgcccaggctggagtgcatggcgatacctcagctcactgcaacctccacctctcgggttcaagcaattctcctgccccagcctcccaagtagctgggactacaggtgtgtgccagctactgcactacaggttgacccactgcaacctctgcctcccagggtcaagtgaccctcctgtctcatcctcccaagtagctgggactacaggcacatgccaccatttctggtgcatttttgtatttttagtagagatggggtttcaccatgttggtcaggctggtctcagactcctaacctcaggtgatccacccacctcagcctcccaaagtgctgggattacaggcatgagccaccgcatctggtctattctctctactttagaaatgtcttcaaatttccatgataaaaagtttaaaaattataattcatgtaaattttttatgagaggctttcagtttcacctctgacatgtcagagcttggaagtcaacgttcccatcctagtaacaagaaaaagctgtataaactgaaacgtaatgacttttccggggcccatcagagaactgaggattcagggcaagttgccatcccaaaatcttgaaagaggcaagtccagagactcacggttgacatctacttacctggaacagaagccactggagtcataagctagtagcaaaacttcaatggtaattttggcaaatgactcagggctgagtgtagactagtgtgggagtgaggaatgtctgggtctgcaggctctggcgggcacactctgctgggctttccctccaggaaccccagcaggttcccataatgaaacactaagaaaaagctctaggactagagtaaaaggaaagaaattgtaaaattcacccagaaccattcccagggaaaagactgctagagctgtatgccagctgttccagccccctctagccttcctctaagggtgaacccagaatcaagaggagtgggggtttcaaggaaacagactgggaacatggcagccaggaaaaggagtcaggggcagggaaagacaaaaaaaaaagaaagaaaaaaagctatgctaggggagaactacttgtgaagatcatcttcttggcctgctgtccagaggagcccaaagtggctgggaggcagtcttaacttccagttcaatggactcattgctgtgcctcccgatggaagcatttctccctctggaactaaaaccacaaggccagcagaacctgaggttgtggagacaggaaacaaaaattttgctaataaatcactaggggtgatggtaagtgatgccactcccatttctaccccttgatttctggaccagtgaactctggctatgggagaaacagcaccatagattagttgctgatttgcagcataggccgcctcctggagaatgttgccccagccctgcaaggtattgccacttacctggcactggcactgagactttgaaaggccattccactgttctgtgaagtcggctgcaccatgttgatggggaacatgataagactaatggattccatgagcatgagcccattgctgtatgtctttggctgtgaagtgagttccttgatcagaagcaatgctgtgtggaatactatgatggcaaatggcattctataagtccataggtggcagttttggcaatagcactgcatgcagaaaaggcatatatgtatctggagtatctattccagtaaggacaaaacaatgcctcctccatgatggaaggtgttcaatgtaagcaatctgccaccaggtagctggcggatcaccgtggggactggtgccatatctgaggcttagtgttggtcactgctgctgacagtttgggcatgcagtcgtgtctgtggccaggtagtccttggtgagtggaagtccatgttgctgagcccatgcataacttccatccctgccaccatgacactttgttcatgagcccattgggaaatgacaggggtggctggggaaagaggctgactggtatccacagaatgggtcctcctatccacttgattattaaaatcctcctctgctaaggtcaccctttggtgagcatccacatgggacacaaatgtcttcattctttctttctttcctttctttcctttcttttcttccttcctttctctctctctctctttctttctttttctcattcaaagagttttatccacacacctcttcctcagatctccttctcagtaattttccactcatgtttcttctaagtccatgaccatccagcaaaatcattggctacagcccatgaatttgcatataatcacacatctggccctgtctcctttcaagcaaaatgaataagtttcaagtagcactgcttgaagttctgcccacagagaagatttcctagaaaggggttcttgtgctgcagctatccacttttgggtagtgagtgcgtattgtgcagaattgtctataaataaggcctaagccttctcctcctctgtcagctggttgtagggaactccccattaggtcataggtgcagtctgggagagaggaggcagtgtagctggagtgggaaccatgggcatttgggccacttcttcgtgtaccttacttgtaccttgagtgctctgtcctatttgatgacagtgctaccgttcgtgtctcactttatggcttggagggtcaaataacacccagttcatgatgtgccgctcaggtcccatagttacttggtggcccatagttaagtgttccgtgttactaaggcccagtgtcactaaggctaaaaggtgtttcccaaaaggaaaataattatctgcagaggatgagagggttttgctccaaaatcctaaggtcttgcactacaattcacttatagggccctgcctaagactgcaaacagcatctctatctgctactagcacttcaagcaccacttcatctgctgggtcatatggcccaaggggtaaagcagcttgtgcagcagcctcagcctgttgcaggccttcctcctgctcttggctccattcaaaactagcaggttttcaggttacttggtagatggacaaaaaagcacaaccaaccaaatgagaaataagtccgcttcaaaatctaaagaggcccagtaggtgttgtgcctctttcttggttgcggagccagatgcaacaactcctccttccccctagaaaggatagctccacgtgccccacaccactggatctttagaaatttcgatgacatagaaggcccctgaatttttgtcagatttatttcccacctactggcacacaaaagtcttaccgagaaccttagattagtcactacttcctgctcagcagatgcaatcagcataaggacatccatgtaaggactaatgtgatgttttgtggaagggaaaagtgatgaaaaaccctggaagctaaactatgacagagctggagagttgatatacccctgaaatcgggcagtgaaggtatattgctggcctagccaactgaaatcaagtagcttctgatggtctttactaataggaatagagaaaaaagcatgtgccagattaatagctgtataccaggtattagggatgtgttaatttacccaagcactgaaaccacatctgccacagcagctgcaatttgagtcaccaggttaagccatgattctatgtttttatgatttaagttaattttttattcacttgatgtagaattcttctgcagatcaagtaaggatttagtaagcatcttacctatttcacttctagaagtaccatgatcaccagccagtgccacagttgtctgcaggtcagactattacgatggctgctttgactccattgttcattacagcagccccacctgccttgtctttagtgactgagtgccaacacatggtccctgccacccagattcaactaccctcctttgcattcaggttttccaattcagtggcagcagttcccactctagtttctgatctacagagagaagagtaatcaaggggctcctcaaggatgctggagatccccttgcaaatttgtttctcacagttgtagtgaaaggtgtatcctctagactctccagagtgagtgagcaggtctgaggtgacaaatctactctgccgttctaatttcacaagcctttgactctctttctctacaaaatgccaaggcaggtgtggcatttcacatttatttcctgtgggccacgttttgctccttgtttcatttaaccaaccgagcaacttgtagagcctttctaactccccaagctgcaacattaaatttagaatatccacttagtagtcgatgttaacagttccagctggatccaactttatatccaactctatgttctttctctctttattccacacccttactatccctggatttctgtctgcgtacactggaaaaatcatgtagttttttggagtgtagtgcactcttcgtggatcccactatatgccttacctttaggggtcttctgggatgtgagtctagttataggcctagaagcagagcagtgctgggggtggatcctgaggggaatcagcattgtcttgtaagacaactaccacggaggataccattacagtttcctcagacggggatagaataatagcttctactggtaaagaaactcagcagaatctaggggttcaatgtccccagcctcactggggtcttcctatatatccccattccattgtttggaatctcattccttatcaatccctcactttaacagtagacaccttacaaggctgggaattctatttgtattgtaattcagtaacttgtaggatgagattctggatttggttttccgcaatctcagctttgcaggtacaagagttaagtgtctctttcagggcacagaaagctttcagatcattcatgtggatttgaatcaaatctctgaactccttttcttcttcaatttgtccattgaaagcaggagctaccggccaatcttgtcttactcattagcttgacaaaaatgtttgaagggtatcacccagatccttgcttcttgatgagtgtttgattaggagtatctaatgacggtcttttgcagacctgtattaccacacagcaccatggactatcagtgctccttttactactggaaatagtcattcatgtctttaaatctaatcagattagagacaaaattacagaaaccccaacccagaaaactcattcttaaaattctgttcctttagaaccactttcagtaccaaattctgtgttagggttctccagagaaacagaacctatatctgaatccatattggtacatatatggtgtattgatgctatattttggtttgtttgatattttcaagcctcatgttgagatttcatccccagcgttggaggtggggcttaatgagagatatttggtcatgggggcagatccctcataagtagattaatgttctccgtggttggcgtgagtgagttctcactttattagtttctgtgaggggtggattttaaaaagagcctgacacttcccctctcccttgcttcctctctcaccatgtaatctctgcacacactagttcccattcccttcccaccatgagtggaagcagcctgaggccctcaccagatgcagatgacagtgccatgcttcttgaacagcctgcagaactgtgagccaaataaaattcttttctttataaattgctcggcctcaggtattactttatagcaactaagacatttgacatgtacagttagccttctatatccaaggtttctgcagaagggggttcaaccagttgtggatcaaaaatgctcagagaaaaaacaataaaaggtatcaatacaataaaaataaaacccaatacagtataataattattaacatagcatttacactgtaataggtattgtaagtgatctagaggtgatttaaagtataccagatgatgtatgtaagttatatgcagatactatgctattttgtgtaaggaacttgagcatccaccaattttgatatctgcaaggggtcctggaaacaatccttctcaattactgagggacaactgtatatagtttgtgcacacacacacacacagacacataacacacacacacacacacacacagagggcagggagggggaaagagaaaattttctcacacatctgtataggttgacaagtccaaaatctacgataggctagcaggctggagacctagggaggagcgaatgttacagcatgaatccaaaggcagtcttttggcagaaatccctctttctgagggaggtcattcttttttctttaaggccttcaactgcttgatgaggcccacccacattgaaaggtaatcttctatactcaaaatcaactaatttaaatattagtcattgcttaaaaaaaagcatcagagaaacatctagaatagtgtttgaccaaatacagtagtcctccctcatcctcaggagacgcgttctgagacatccagtggatgccagaagctatggatgttaccaaaccctatatgcactatgttttctcctatacatacatgcttatgataaagtttaattgataaattaggcacaataaaaattagcaacaataactaataaataataaagtagaacaattaaaataatattctgttcaaatttcaagaatagatttttatcttactgtagatattagcaacctcggcttatgatttttttcttattaagttgagaactttcaccttttcacttaaagtaagcactttacagcttctctttggcatatttaaattgctggcattactacttatgtgctttagggccattatgaagtaaaatgagggttacttgaacacaggcactgtgatacccttatagttgacctgacaaacgaggtggctactaagtgactaatgggcaggtggtgtagacaggatagaaatgctgtacaaaggccaggcgcagtggctcatgcctgtaatcccagcactttgggaggccgaggcaggaggacacctgaggtcaggagttcaagaccagcctgaccaacatggtgaaacctctctacaaaaattagctaggcgtggtggcaggcgcctataatcccagctactcgggaggctgaggcaggagaatcacttgaacccacaaggcagaggtcgcagtgagctgagatctcaccattgcactccagcctcggcaacagagcaagactctgtctcaaaaaaaaattaaataaataagtaaaactttcatttaaaaaaaaaaaaaagaaatgctggacaaagggatgattcatatcccagctgggacagggcaaggtggtatgaaatttcaccgtgctactcagaaggaggcacaatttaaaacttatggattttttatttctggaattttccatttaatatcttcagaccacagttgactgcatgtcactaaaactgtgaaaagagaaactgcagataaagaggaaccactgtatctgggtactgtggcctagccaaatcaacatgtgaaattagcaactaaccatcaacaaatatttaggtgtaaagctaacaaaatatgtttaagatctagataagaaaaactacaaaaatctgatgggagatattacagaaaatctcaataaatggagagactccatatacatggataggaagattcaatattatcaaggtgaccttctaacttaatctagagattcaacagactcccagtcaaaatcccaacaaattattttattggatatcaacacactgattctaaagttaatacagcaggccaggcgcagtggctcatgtctgtaatcccaggactttgggaggctgaggtgggttgatcacttgaggtcaggagtttgagaccagtctggacagtatggtgaaaccccatctctactaaaaatacaaaaatcagctgagtgtggtggcatgcacctgtaattccagctactcgggaggctgaggcaggagaattgcttgaacccaggaggcagaggttgcagtgagccgagatcacaccactgcactccagtctgggtgacaaagtaagtgagactctgtctcaaaaaataaaaaataaatacatatataaagtttatacaacaaacagcccaaaatagacaaaaaaaaaatattgaaagagaagaagaaagtagggagactgacagtacctcacttcaagacttgtcataagactacagtaatcaagtgtgaatagacaagaatagacaaatagactaatggaacagagtagcccagaaagagtcccacacaaatacagtcaactgatttttgacaaagaagcaaaggcaaattaatggaggatagtcttttcaacaattggtactggagcaactgggcatccacatgcaaaaaaaggatagaccttacaccttcacaaaaattaactcaaaatggaccaggaaacgaaatgtgaaaattcaagtctataaaatgtctggaagataatataggaaaaaatttaggtgaacttcgatttgacaatgactttttagacacattccaaaagcacaatacataaatgaaaaaactgacgttgaattttatcgaaattgaaaaacttgcattctgtggaaaacactgttaagagaataagaagacaggccacagactgggagaaaatatttgggaaagacatagttgataaaggactgatatccaaaatatacaaagaattcttaagactcaaagtaagcaaatgaaaaagttaattaaaaaattaatttttaaaattaacttgcaaaagacctcaacagatacctcactaaagaagacatataggccaggcacagtggctaatgcctgtaagcctagcactttgggaggccgaggcaggtgatcacttgagctcaggtgttcaagaccagcctggccaagatggagaaacctggtctctactaaaaatacaaaaattagctgactgtggtggcgcatgcttgtaagtcccagttactcaggaggctgaagtgggaggatcacttgagcccggaaatcagaggttgcagtgacctgagttgaggagtgtcactgcactccagcatgggcaacagagcgagatcctgtccaaaaaaaaaaaaaaaaagacatatagatggcaacgagtacataaaaagatactcaacatcacatgtcatcagagaatttcaaattcaagcaacaataataagctacacacttatttaataagctatgcacttattaaagtagctgaaatccagatcaaatgctggtgaggtttggagcaacaggaactctctctcattgttcatgttagtgtaaaatgactcagccactttggcagaaaatttggcagtttcttacaaaacaaaacatactcataccacacaatccagcaatcgtgttccttggtatttacccaaatgagttgaaaacttatttatacacaaaaacttgcacatgaatgtttatagatgctttattcataattgcccaaactgagaagcaaccaagatgtcctttaatatgtcctattaaaggtggtacatctcggtcctattaaaggtggtacatccatacaatggtctattatccaaaaataaaaagaaatgagctgtcaagtcaagaaaaacatggagggaactgaaatgcatattgctaagtgaaaaaatttaatgtgaagagggtacacactgcatgattcccactgcgtggtagtctggtaaaagcaaaaccatggagacagtaaaaattctggtaggaaaaggagggagggatgaataagtgaagcacagaggacttttagggcaatgaaactcctctgaatgatactatcatggtagatacatgtcattatacatttgtcaaaatccaaaccaagaatgaaagttaatgccactatggactttagttaataataatatatcaatgtcggttcatcaatagcaaaaaacacaccacactaatgcaagatgtttataataagaaaaattatggggggtggggatgctgggggtttagaggaactctgtactttctgctgaatttttctttaaacctaaaactgctctataaaataaagcctattaatttagcattttttgggtgttttaaggtctgctgtcagtgctgagacaatgccagtgaccacctgcagatggttcatgctggtggcatccttgcatcttggagctttctccagctgccagaaaatgctcaatctgtgggcagggcaggctgaaaataccatacagttaacactcacaggagtgtctccaccaataagaaaagaaaatcaggaatcaatatcccagtttcctcatccccggttgtcactctgctgaagtgttttctgcacagttgctcaaagggtcccagtgggattgagctctattacccacaacagtaacccactcaacaatgagtccttcgataactttcctgtgtccccatctcgctttcctatgtcctcgctgggcttcctgccattaccgctcaaattcgtctcagggttggctgtgggggaaacccaaaccaagacaggaccagaaccaagaaaaaaaggctcgcagcttcgcctcaggctatccacaacatttccaaatgccctttcattttctttctttctttctttctttcttagtttctcgctttcttgctttcctttttcttttttttttttttttttttgacagagtcttgctctgtcacccaggctggagtgcagtggtgtgatctcagctcactgcagcctctgcttcctgggttccagtgatcttcctgcctcagcctcgtgggtagctggaattgcagacactcaccaccatgcttggctaatttttgtatttttaatagagatggggtttcaccatgttgcccaggctggtctcgaactcctgacctcacgtgacccatccaccttggcctcccaaaatgctaggaatacaggcatgagccaccgtccctggcctcatttcttttctaattgcatgtgattttcacaagaaccaacctcagaaataagataattttttaaattttttttactgttttcctatttgaatgattgatattgttgcagttttgttttccacacttttcattgcagatgcagagtgttttaattatactatgtattgaaaagtttctcatgggctggcctgagacacaaccaactttaacactgtttctataggaaagggaattccaaatgaaaaggaacaaacttggaaaccaagtttcagaatgtgtaaattgagtgccaaaaagtttaggtggaagataccaagcaaactggcccaccactacgtgtgaccatgtctaccaactttatcttaaggttttgtttagtttttttgtttgtttttgttttttggtttttacttcttttaaatttattttgattgcttgataatagacacatttagaagcttctatcagtttccctacatctgccagcgactggcatcattccattttgcttggataattcagtagcatagcctcctgtggaaatagctgcttctggcaaaactgtttagtttatcatttaatcaaaacatttgcatagttccactcagttagaacacaaaaatgaggctgatcgtttttgcataaagacaagtcataaagtcataaagcaaaggaatgctttaaaccatgaaatgaaatttaattaaatattggaaagacaaacatttcaccatgagcagacattcttaaataatggttaaataatacacaaaagaaattacagttttacatgaaaagggtatttagtggtgactttataaatgtttccaaaaaaccatttataaacgctgggctgatgtgtcttgctgcacccaaggcattgctctcctacctttcagcacgcagttggctgtacctcatatgtatttggcctggacgtgttctcatgtgacagtagcagtgtcccctgaaaaacaccttgcaaacattcatacgctgcctagtctgtgcgatcagcaactcacagggtcacctaaaaacatactgcccctctccaggttgaggagaaaggcttggggaaaattggagaatccaagtgtcacccaacacggcggggctcagaggcactgaaagtcacttgagatgcggagggcacttggaaggctgactgggtcctgtggaccaacaagtttaagaaaggatctatcctaagggaaaaggcagtgtttctaaagtcagcatccatcccatccttttcaagtgggaaagagctgcataggaggccctttgggattcaggaaacatccagcaaggaagccaaaccgctttagacaaaatccacaaacttgagaatctgatcaggactctgggacctctatagttttcttctcagcagcctcattaagatataattcaatattatgtagttcattcaattaaagcatacaactccataatttttaatatgttgtcaaggttgtgcaaccatcatcacaatctaacctaattagaatattttcagtttccaccctcaaagaccaggcacccattagcactcactcctcataaccctcctaaccagccctgccctaatcaacgcctaaactactttctgtctctgtaaacttgcttatcctggacatctcatatatacagaatcacaaaatatgcaggcttgtgtgactggcttctttcacttagcataatgtttcaagttcatcatatcgtagcatgcgtaagtatttcatttcttttcatgccaataatgttcccttataagaatatactacatgttatgtatccatttgtcagttgatggagaattggattgtttccactttttcactgttataaataatgctgctgtgaacattcgtgtcaagttcttgtatatgtgtatgtttttaattcccttgggtataaatacctgaaagtagaattactggaacatgtagtttaacattttgagtatctactaaactgttttctacagcattcccatcagaaacagaggaggattccaattcaccgatcttgttaacactgttattgtctgtcttttttattgtagccatctagtgggtaagaaatggtatctcattgttattttgatttgcgtttccctaaggactaaaaatgttgagcaacttttcatgtgtttatcagtcatttgcatatttctttggagaaatatctgctgaagtcatttgtacttttgaacattgggttgtctttttattattgagttgtaagagttcttcatatattctggatacaagtcccttattagatgtatggtttgcagatgtcttttcccgttctgtgggttctatttttgctttctcaatagcatcatttgcagtgcaaaagtttttggttttgatatagagcaataatcttttattttctttcattgcttgtgcttttggtgtcgtatgtaagatgtccttgcttaatctaaagtcatgaagatttactcctatattttctgccaggagttttatagttttaacgtttccatttgggtctatgatccatttttagttaatgtgtgtgtatgatgtaacataggggtccttgtcattcttttgtgtgtggccatccagttgttcctgtatcttttgttgaaaagaatattctttctttattgaattgtcttggcacccttgttgaaaaacagttgactataaatctaagagtttattactggacactcaattctattcccttgacctatatgtttatccttatgccggtacaacactatctgttgtagtgtatgcaactacaaacactacctttacggtaagtttcacagtcaagaacaatgactcctccaactttttttttcaagattatttttactattctaggtcctttgcatttccatataaattttaagactagtttgtcaatttctggaaaaagctacctgggattttgctaggaattatgttgactctatagatcaatctggagagtattgccattttaacagcaacaaatccaaaacaatgggatgtctttccatttatttagattgcctttaatttcttttaacaatattttatagttttcattatacaaatttttgtacttcttttgataaatttatatctaaatattttattctttttgatgctactttaaatggaactgttttcttaattttatttttagaatccttgttcattgcaaaagaataaaaatagaattgacttttgtacattgatctttcatcctgcaatcttactcaactcatctcttatttctaatagtttttagtagattttattaggattttgtgtctataaagtcatatcatctgataatttacttcttcctttttaatctggatttttttctctctacttgtttctttcttttgttcttttttcccctgactgcctccagtccattgttacatagaagtggtgagagcagacatccttatcttgtttctgatcttagaaggaaagcattccttccttcacccttaaatatgatgttagctgcaggctttttgtaacattcctgtctagaacactgaataagtttgcccctattgctcaccagcattcttctgttttctgaagctggatgtgctcgtagcgtgttagtaaatgtataacaactggttcttcaaaacattttttgttgcatttggggatttctgtggtgtaaatactcccaccatggtttaatcaagctacaaacctgacatcactgaatacagagttgggaagagatactcagtatcacatcagtatatagtatttccactacacagatacaataaacatatataattttaagaacataaatggactgggttcccctctatttctagtttgttgaaaagtttttgtcatgaaagggtgttggatttctgtgaaaccctttttatatctattaggctttattctaccaatatagttcattgtattaattgagccctcacaatggctttctgcttctacatttgctactacatgagttgcttatttgtagaaaaccctgtataatagcatattttgctaaggaatcgaagagggaagttagaggctgaactttagttgaaaagtgtgttccagccgggtgccgtggctcacgcttgtaatcctagcactttgggaaactgtggtgggcggatcatctgacgtcaggagttcgagaccatcctggccaacatggtgaaaccccatctctactaaaaatacaaaaattagccaggcgtggtgatacacgtctgtagtcccagctactcgggaggctgaggccaagaagagtggcttgaacctgggagatggaggttgcagtgagccaagattgtgccactgcactccagcctgggcaacagagtgaggctatgcctcaaaaaataaaataaaataaatgtgttttggggggaaagagagaaagcagaaacaggaaactgatgatgtccacttcaatgatgaagggaaagtaattggaatctgtacagaaaagagccagagggacggtcaagtgggtacatagactttaagaggcatttttcacaaagtcatcattgttatagtcattaaaaataaactctgaaattacaatcaactattttatcaataatgataataagtactcaaaactcatcactgcctaattagtttgctacattttactgctacttatgctcttaaaaatatgtatgctcattgtatctgtgtagtggaaatactgtatactgatgtgatatttaatatctcttcccaactctgtactcagtgatgtcaggtttgtatcttgattaagttattgtgggagtatttacatcatagaaatcagcaactgtaacaaaaaaattttctgaagagccaactgttacacatttactagtgcaccaccactagcacactcagattaagaaaacagaagtgggatgggtgctgtggctcacccctgtaatcccatcactttgggaggctgacgtaggtggatcgcctgatgtcaggagttccagaccagcctggccagcagggtgtaaccttgtctctactaaaaatacaaaaattagtcaatcatggtggtacgcacctgtaatcccagctacttgggaggctgaggcaggagaattgcctgaacccaggaggtggaggttacagtgagccaagattgcgtcattgcactccagcctgggcaatagagggagactcagtgtcaaaaaaggaaggaaggaaggaaggaaggaaggaaggaaggaaggaaggaaggaaggaaggaaggaaggaaggaaggaaagaaaaagaaagaaagaaagaaagaaagaaagaaagaaagaaagaaagaaagaaagaaagaaagaaagaaagaaaataaaagagggatgcaggtgagcaataggaaaacattatataattttctagacaggcatgttaaagagaaatatatagctctttcctactgtttttccctgggaaggattaagaataagataaattcaattcacgaaaggtttactgaaggcaacttcctgtgtgttcagcactgtggtagaaatccagcataaatgcttagaatgatttatgcaaagggtgcctctttgtggagatggaattaaatgatccacagaagtttcttttatttcaaagaatctattcatctataaagaaatgcataatacaaggcctagtagccaagataattgtttttctccagactgttgaattgcaacatcattttcttctatttacatttaaagcattcgggtcattcaacgtttgagctccttctaagatttatataaacagatttttgaaatgcagataattgttatttgatgtagctcttccttattgctttaaaaatgacttagagaactcaaataaattaatctggagtaatcttctttttagtgatccaaagcaattgtctttcaataaaccctgtgcttataagagctgcataatccagtcggtgtccctgtctcctcttgcttttgcctgagctactgatgtgtatagcaggacacaggaagagaatcacagtcatcttaaaaaaaattattcccttcattttaatctgtcatctttgctgaacaatatcattttaagagcttaatcttgaaaacagagccacatttaatttttattttattagaaaaattctttctgtctacacaaccacaaatagtgtttagagatcccaaattaaatctgctgttgatgtgaagtggccaagctcgtggtggtgttgataggcactcaacagcactggggcatccataaaaatattcatggggcttcctcttccaaccacatgaagccagaatggacatgaaacttcttcccatttcaaatatgggaatgctgaatctagtagagaaaaaaataaattttaaaaaataagcatggatgggtgcagtcattcacatctgtaatcctagcactttgggagacctaggcaggtggattgcttgaggttaggagttcaagaccagcctgggcaacatagcaagatcctgtctctacaaaaaattttaaaatgtgcctgtggttccaagtacctgggaggctgagatgggaggattgctggagcccagtaatttgaggctgcagtgagctataatcgcaccagtgcacttccagctgggtaacagagtgagagaagaaagaaaagaaaagaaaagaaaagaaagagagaaagaagaagggagggagggaaggaaggaaggatggaaggaaggaagggagagaagaaagaaggaaggaaggcaggaagggaaggaaggaaggaagggaaagagggagggagggaggaaggaaggaaggaaaagaaagaagaagagaaagaaaggaagggagaaaagttcgactatgcagtttatctcacaagaaagaaaatgccagacacaaggaacaatcggagagtgggagtgtcaaccttgcacgatcttgctatagcatcctggggaatgagaatggtattagatgaagttataggtcaaacagccagacttggatgttaacacccacagaaagacaagatatgaggctgtgggtccaagtgttaagaccttggtataaattgggggtttctaaaggttataatgtcggttaagaggtgataaaaagttcctcccaccagccagggtaacgacaaagaggcttcttccatcaaaggatctggaaagaaaacaaaatatctttcattaggaataaaaatgccaagccagagccacatgtgagtctagaatttatactgtcctcgtgctgtaagacgcttcaaggcaagaaactcacaaaactgtaatggattaagaactaccccagaagaaataagcacacagctcttttggagaaacagcttcacaatgcatgaaatgtggggttgccacagaaaaaacaatctccaacaaaggaaggatttttttaagcaaacaaacaaaaaaaagcacagaccatgaattgaaatactttttaaaatccactacataaaaattaacatgtgaaagacattatggagtaaaaggaaaagggagatctttcactgagagaagatattttcatgtgcttagcttgtagtatattaaaatctgaatatgtaaagaaacaccacagataaagaagaaaaatacaaaaacccaattagaaagacaaaggttattgtaggggccatggtaagttgcatacctaatgtcctttctctcatcttccctgcaactttgaatcagatttgattatggtaacagtgaacatactcctggataagagtcttgcttttccagtctttcttaggtccaagggtagccatgtggcatggcataggtctggctaatgagacacaaagaaagaatctgctgagggggcttataggaaaatcatttctctccggatagaaagggggggggtggatcttactagagccatgcctccctctgccttgaaggctaatgtgatatctaaaatgatcatgtagacacaggcaagagagaaaggcccagagatggccagaggcagagggtctgccatcaatgagccattgacacagaagtgctaagtggatttaacatttgaaaatcaatcagtgtaatccaccatattaacatattgaaaaagaaaaacaatacaaacatgtcaacaaatgcagaaaaaccatttgatgataaaaaaagaattaataaacagatttattaactggtcagtcagactcattgaaggtggaaaaactcagactgtttttcctctgctcacaccacaacaatcaaccagaagacttccgtgactgaagggccatggagtttcctacacacacaaagcaagcaatcagttctgcagcagacaccaactgggtgtcctccaattcaattctgactctatctacctggagatagcatcaaatcctgcaggctgagggctcagtctctcacactaccccctcttcagacaccaatcacaagtctgggcctccagaacttctaactggttagcttcaagttgggcttcctacaaccctttcttcaggtttgataatttaccagagtggctcacagaactcagggaaacacttatgtttactggtttattataaatgatattaaggccggtcgcatgcctataatcccagcactttgggaggccaaggcaggcagatcacatgacgtcaggagctcaagaccagcctggacaatgtggtgaaaccccatctctactaaaaatacaaaattaaccggatgtggtggcgcacggctgttatcccagctacttgggaggctgagacaggagaattgcttgaacctgggaggcagaggttgcagtgagccgagatcacgccattgcactccagcctggggcataagagtgaaactccatctctaaataaacaatattacaaggtaacagataaagagacacatacggtgaggtatgtgggataggtgcagagctcccatcccctccccaagcatggcaccctccaggaacgtccacgtgttcagctatccagaagttcttcaaatcctattctcttgggtttttatggatgcttcattttgtaggcatgattgattacatcactggccatgcttctctgccttacccggagtttgaggagtagggctggaagtcccaaccctgtaatcctgccttagaggtcataggcccaattgtttctcatatatatgtctttgcagtgaccaggccccattttgaagctgcctaagggctgccaaccatcagtcaactcattgggatacaaacagacgtcacttaagcgagtctaaggattttaggagttctatgccaggaaacggggattgaagactaaatatatattttatctggcctgttgctcaggctggtctcaaactcctggcctccaggggtcctcctgtctcagtctcccaaagtgctgagactacaggtgtgagccaccactcccactcaccctgtatcttttaatatggtattttacattaattgattttcagatgttaaacaacgttgcattgctggtagatactcccacttgatcgtagtgtaatgcttattattattatttgttgctggattaagtgcgttaatatttttaaagactttttatgtgtatgttcacaagtgatattgatctgtggctttctgtacttgcaatatttttcttttggctttgttattacggtaatactggcctcatgaaatgagttgggatgtgttccttgctccttgactgtggcagaagaacaggcaagtttctaaactgtttggatgcagagcctttgactctgaaggtaggaggtagaattttatcacaatgcacgcgctaccttcccaactgagcctggcctcaggacttggaccttaggttaggggttctatgcttgacacatactagtagtgattgatagggacaggatgtttatgttctgaagtttttgtataatcctttttatttttcctccttaaatatttgaagatcttcactagtaaatccatctgagcctgggtttttcttttctttcttttttttttttttttttttttttgaggttgagttttgctcttgttgcctaggctggagtgcaatgatgcaatctcagctcactgcaacctccgcctcctgggttcaagcaattctcctgtctcagcctcctgagtagctgggattacaggtgcttgccaccaggcccagctaatttttgtatttttagtagagatggggtttcaccatgttggccaggctggtctcgaactcctgaccttaggtgatcctcccaccttggcctcccaaagtgctggaattacaggcatgagccactgtgctcggccaggtttttatttatggggcaatttaatcaccaattaaaactccttacttgattttctatttcttcttgaaacagtttcagttatgtctttctaggaatttgtccattccattatggttcttgggtttgtttgcatgcaattgtttataatatctttctaatccattcaatttctttagtctgagtgatgttccctattctgtttctaattttggaattggtgtcttctctcttttcttcttaatcagtctacctagtggtttatcaattctgttgatctttccaaagaatgaattttttatttcattgatgtttctgtattggtctttttaaaaattgacttttttctggtctgattttcattattgccttttttctttttctacttactcttgctttaattcactcctttttctagggttttggttttttatgttttgttttagtctggacactacaatgaagcaggatatttccctgacctctctgtgggtgggaactggagtgcacgggcactggaactagccactacttcagcaccgacagggcaaactccacttgcttgaacctgctgcgttccacccctcgtgggagggggacttcaggtgagcaggtgctggagccaggacgagcacttgtgggctctggcaggagcaaaactctatgcgggcctgcctcaacatctgcaaggggtacccatgacccctgaagccccagagggagtgttacagtactcctttagctctgctgtccacgggcagcctaagtgttaacagctcagtcaaccttctgccttttcgcctgaggcagctgcctcctgccagcgagggcaaagggtcagtgtgacagccttttacatccacactcgtgacacccaagctcttgtccagcgtccaggaaaaataaggtcacatgaacaaattgaaggatggtaaatgtcagggatttattgccgatggaagtggctctcagcaggaaggggatctgaaaaagggacagagtgggaaggtaatctcctgatgtccagccttctccggccagattcttccctaaagttacactatcaagctgtccctctgaagtcaagctgcttctctctgatgttcagccatagtctctgatatccagtggcttctcctctctctgctggctgagcctggggtttttatagacacaggatgggatggggtaggggtatgggtggttttggaaaaggcaacatttgatggggaaaacagggatgtaagttctcactttgggcagtggtttcaggctttttggcttgaaggtgggacccttgctgagcactcaccatcttctgtccagaatttccctgcatcctgtccctatcaatcactactagtatgtgtcaagcatagaacccctaacttaaggtccaagtcctgaggccaggctcagttgcgagggtagcatgtgcattgtgataaaatcctacctcctgccttcagagtcaaaggctctgcatccaaacagtttagaatctttcctattcttctgccacagtcaaaagaggatccacagccccgtgtggccctctcccttctgtgctcacaacccttcaaggcaccctgctgcggagttaagcacaactttttttcctgaccttgggcagctggcagctccccaccccatgccctcacagaagcctagggcttccctctccaggatcaggcattccttccatcccccaccctcctaaatttaggacagggatgctttagtgccactgtctctcttccgggactgaccacacttcattccaaataggaaaagatagaggggaaaaaagggaggggcgggagacctggatgctggagagttaccccctacaagctgccctcagggaccaggtgcccaatgccccacggactgcagtgaacccagagggagccctcagtgcccagagggagccctcagacccctgctttgcttgccccctgggctccatgcccttgattctcaggccagagaggaaagggtcccttccctctcactctggcagctggtggagggtaggatgcagcactgagccctttttctagcttcttgatgaggaagcttgttattcttttttaaaactttcttttttcaaatataggagtttaaacctataaatttccccctaagcactgatggcatcctataaattttgaaatgtggtactttcattttcattcaatttgagatatttttaattttgtttgtgattccttctttgatccatgaatacttggaaactggtagtttagtttccaaatgtgtaaccgttttccatatttatttctcttgttgattgctaatttaatttttagtcacagaacatttgcattattgtaagccctttacattttttgaaacttgcttgataagctaaaaaaaaaagatctccccaaaggtattcatttcctaatccctgaaacctgtgaatgtgacactatatggaaatagggtctttgtaggtgtgattaaattaaggatctcaagatttaagtcatgcagccacaagccaaggaatgctgccagcctccagaagccagaatttgccaggaagggatcatcctctagagcctctgcaggaagtgcagccctgctgacttctggatttcagcccagtaatactgatttcagactggaagtttggaattctggagtccagacttgggagaggatacatttctgttgttttaggccaccacatttgtggcaactggttacaacagccacaggaaactaatgcaactcgtttcatggcttagaatagggtctagggtctattctgtagcacagcggtccccaacttttttggcaccggggaccagtttcatggaagacaattttcccacaaacgggtggagtgggtgttgtgggatagaggtggtggatggtttcaggatgaaactattccacctcagatcatcacatattaggttctcataaggaacacacaacctagatccctcacatatgccgttcacaatagggttcgtgctcccacgagaatctaatgccaccactcatctgacaggaggtggagctcaggcagtaatgcacacccgccgcttacctcctgcggtgcagcctggttcctaacaggccacagactgggactggttcctgccaggggttggaaatcactgctgtaggatgttccttgaagtccaggaaagaatgtgcattctgttttggggtagcgtgttccatatatgtcccttaggtcaagttggttgatagtgttgttcaagtcttctatacccttcttgactttatgaattgctgttctatcaatatttgaaagactataattaaaatctccgactttatttctgctctcaattctatcagtccttgcttcatgtattttgagacccagtgttaggtgcatttacatttataattgctatatctttctgatatgtttaccctcttataattgtgaaatgccttctcttctcttgtgatttttcttctttcaaaatcagtttcatctgatattagtatagctaatccagctctctttgcctactgtctgcctagtgtacattgtgtcatccttttattatctacctacttgtttctatgaatctaaaatgtgtctcttatagatagcctatagttgcatggtttcagggtgaaactattccacctcagatggaagtctgtgacatctgcaaaagatgtcctaggagagaaagtgggagagagagagagggcatagattcaattgtttctcatacagacatgtctgtaatttccacaattactgccctaccctgcaattcagttggtttcccaacatccagcagttctcctgcttagcttctccagtgaataatactcatctcatctataggggcagtggttggaggacctggaggagtgacttgcctgagtgtggagggtgaaggtgttctagagtctgactgttccacagtctccagccagccctcattaatccagctgaccactgtatgtactgcctcaaattcctgagcatttcacaagttctgcaaggcagaacactctcttcccattagcctcaatctctacaggcaccatggattgtaaatttcttcccccttctaaaccagttgtatcatctgatttttctctcccaaaaatctgttgaaattcctttttttccccatcatcttctgcacattgcttccacctcatgatcaaaacgactgctcaaattctggctactacatctgcatttcattcagcaggaaagagagggaaataagaaggacattccatcctcttaaagactcttcctggaagttacttgcaacattctgctaccttctccttgaccaagtcctacccacatggccacactaaacgcagtggaggctgagaaatgtggtcttcattcaagacagcatgtgtctaactaaaagttgtgagtctatagccaaaggaaaagggaagacagagattggtggacgtttctgtcacactcaagacaatacaatgtttcaaaaaaaaaaaaattaaacaagctcataaaaagaatggctgttcattgaaattacccacattaggccatctcaggtgagtagcaactaatagtgcctattaagtatctaataaatatttgtcaggtatttatttgtctgaatggatgaacctgaatcaaccatcagcctgagagaggggtggctttctgtttactatgacccacgacaggtgacaacatccatttttttcttttactgagtttatcaacaaacagaaaacctcaacctgcttctgacatcatatgccagctttgcatcttgctactatattatacctggtcttaaacctccaggcacactaaccggtgccaagtagaaagactggagagaacaaagagaaaaatcaggaaacagcaagaagtctttgactcacatgtaccaacaaagcctctcccaacacagagaaatggtgataacgtaatcacaggcatgctagccattgttccagtggacttgaagccaaagccgggattaaataaatggctggcatttttcaaagaaccagaggcagcactgtttaaaagagctgacagctgtgagatagagtattcttattacagaggcttagcggggagacttaaagtaaacctttccaccagcagagcactctcaaatgggagaaaaagtagaaaagctccctctatgagagcagaaaaatgcacgaggatataggcatggttctggggctgtcataaagatgtgagaagaccttagtaaaatatcttcaatgttattaaaaccttactctttagaggtaagaagaaatatggggggcaaaaataaagagggaacaaaaaggaacagtgttttgtttaacccatggagatgcaagttaaaatttggatgagtctacgtagcttttctttgtacttcccataaagatcaaaataaaggttctttgttcatcctgaaaatatgcattgaacggaaatattgataggaccctacattctagtgatggcaagaaaggtaactaggaagtgagcacacagactgtttcagtagtaatggcggctagaaaaaggcaccaattgggcagtaggagacagaggggtgattagtggggtaagctgctttagacagtggggccaagacaagaatctctggggaaatgcctttcaagtagacacttgaagtgtaagaagaagctagtctcatggccaggaagtatgaatggggtggagtgaggacggagtgaatttcaggccgcagggtgagcaaggcatggggggtggggctgggaacgctcgctgttgtttgttggtgagctgaggccccagtgctgtggcatgtgtgtggcccatgtgagacaggagaaggaggaaggaggcacatccaggaaagatgtgctggccatgggaagggatcccatgctgggagcattggaagccatcagagggaatgaggtcaggtagtgtcattaacatttacattgcacacaggtcactgtggctactgggtggaggatgagcagaggagacagattagggaaatgagctcgagggctgttgcagtagctgaggtcagagggagtatggctttgctgagtagttgtaaaatggaaagatggagaaagaaatgagagatactagtggaagtacaaaaggacttggaggttgatatggtttggctctgtgtccccaccgaaatctcatcttgtagctcccataattcccacatgttgtgggacggacccagtgggagataactgaaccatgggggcaggtctttcctgtgctgtacccatgatagtgaataagtatcatgagatctgatggttttaaaaacggaagtttccctacacaagctctctctctttgcctgccaccatctaagtaagatgtgacttgctcctccttgccttctgccactgtgaggcctccccggccatgcggaactgtgagtccattaaacctctttcttgtgtaaattgcccagtctccagtatgtctttatcagcagcatgaaaacagactaatgcaatggtggagatgaaaactttgttatacagctgccattgaaaatactagatttaaggccaggcacggtggctcatgcctgtaatcccagcactttgggaagccaagacacatggattgcttgagctcaggagtttgagaccagcctgggcaacacggtgaaatcccatctttactttaaaaaaatacaaaaattagccaacatgttggtgcatgcctgtagtcccagttactcagtggggctgaggcaggaggatcacctgagccttgggaggtcgaggctgcagtgagccatgattgtgccactgtactccagcctgggcaacagagtgagaccctgtctcaaaaaacaaaacaaaacaaataaaacctagatttattatcctgtttgatacctgaaaacacctgtgtgaagccacaatataaaaaaaaagaagtcccacaggcaataacctcctatgttagtagggaactggcatcagcattttagagtcacgtctcatacttaaccaaatgaggaaaaattaaaatttagtaagtatgatttatcatgatatggtagacctgttacagaaaataacaaccataagtgagaagtgttattaccaggcacaggagcccaggtgttcttgtgtgtgtgtgtctgtgtctgtctgagtgtgtgtctgagagacttaggattctctagaatatgaggcctatagcaggggtccttcctgtctggatctaaaggcaatactatttatagatgccccccaaaaggagatgggaggcagatagagcttcctggttttctgatgtttttgcccctcaagtggcaaaaagaaaagtataacaaagattatcttccttgaccaaatttgtcagtttcgtcaagcctgaccaggccctgttcttggccatgtatgcccaattttagcaagaatctttctaaattagtttaaccagaacctcccaacttcaagaactgatggccatcagttctcatcctctaccaccccaggtgatgtctggtcatcctgagttgcctttagcaagaatcatgtttggctggtttagccagaatccccatcacccctgatgtttcttcttaggaacttttcactcactgacccccatcttttttctcggctataaattctcacttttccttatttatgttctgaattaaggtctcttttcccctattgcaatagttcctgattaaaatctgttttcactcttttaactactgtcgggctctgggttttgggtttgtttgttttctggtttgggggttggtttgtttgtttgcttgtttgtttgtttgttttgacacggggtctcactatattgcccaggctggcctcgaattcctgggctcaagtgatcctaccagcttggcctcccaagaaactgagagtacaggcaagtgccaccacactgaacaggctctgggtgattttgttttttgtttttttggacaaatgcgtacaatgggtcctgcaaaaaaatgagaacaacaaatcacaaacatgcattgaacacctactatttatttaccactgtccttggatgaggagaacataatacaagcagttttgtgatgtaactggagacaaaggatgagtctttttttttttttgagaccaagtttcactcttgttgcccaggctggagtacaatggtgtgcaatctcggctcaccgtaagctccgcttcccgggttcaagcgattctcctgcctcagcctcccgagtagctgggattacaggcatgtgcaacacacgcggctaattttgtatttttagtagagacggggtttctccatgttggtcaggctggtctcgaactcctgacctcaggtgatccgtctgcctcggcctcccaaactgctgggattacaggcgtaagccacaatgcccagcaaggataagtcttaaagtgagggactacttcctagctccatgtcaccatcagattctatgcaataattgcacctactctgtacccaaaagaaaattggcaaccaagaaagtgctaagttgtgcggaatagagaaaaagccaattatgtgattcaaacgctgcatgcaaaggcttaaagaaaggaagaattccacaggctgtaggagttccttggctgccttcaaggaaaaagatgtagaaaaggatgctgagttggatgagatgcggctaaccgtgaaaggacatgggaaggggtcattttttcaaagaaaaaatgttattaatagaaatgtatgaaaataaacactaaggagactgcttagccatgttatccttacaaccataaatttccacccgggtacttcccatttaaatccatatctccccacggaaggtggaattctgattcctttgttattccaacagctgtgtttatcaagcacggactgcagggattctcatcctgcagactgactttgcatcccgtaaggtaactgctatgtgtaccccccaaattaatatgctgtggccccctacaaatttatatgttgaagtcctaccctccagtacctaagaatgagaccttacttggaaagaggtctttacaaagttatttataaggttaactggagttattaggttggccctaatccagtgtgactggtgtccttgtaagaggaggaaatcaggacacacacacgcagaaggacaatcatgtgaggatggagaaggcggctgtttacaagacaaggaaagaggcctggaacagattctccctcacggcctcggcaggaaccaactgggatgacagcttgacccccaacttcaggcctccagaagtgtgacacataatccatttctgtcatttaagatgcctgcctagtctgtggtactttgttatagaagccctaggagaccaacatagaaaccaacacttccaatctgattttatttattttatttatttatgttagagacagagtcttgctctgttgcccaggctggggtgcagtggtgtgatcacagctcactgcagcttccaactcctgggctcaagtgatcttcccacctcagccccctgagtagttgggactagaggcacatgacatcacctctataatttttgcattttttttttttttttgaggagacagggtctcactttgttgcccagattggtcttaaactcctagcctcaagtgatccttccaccttggcctccaaaatgctgggattacaggcgtgagccatcttgcccagcccagtcctgaagaccattctgtctgcagtggaaaagggtcaggactagtagaactttgctatctattatttctcatatttatcaaaactgccctccaactatagaattaagaattggttttctccagaggaccactggaaatgtttcagaaacccatagtttactcttcttttgtgaaatacattgcaagataatgaaatcctttcctggacacccagctggcttgtgcgtgaagtgattatgtgtgcccttcacctcatcttttcctcaccaaaggcgagaaaaagggtagatggggaagagagaaacaacgaagtcacttttaatgaaatgcttgaaataggcctattctgaataaggctgttcaaatgtagacactatattctgtagttatatttcacattgtcctgagttccctgatggcacttcttgctcaaagtccaagacttggccctcagatgtgaccctgttgagcctgggcttcacaaacagtcaaatttgagcagagtgttaaaatattgtaattatccggaaaataattcttggtggaaaacattctgtcttttaaaatgggagggctctggactgctgaataggacattctgcatctcagtggtgtgaaactaactggcttggggctgccccttaccttgaatccctgcagaatgaacgcacgctggctgaggagtgctatctctgtaacatccagccagtctcagccagtctccggcagctgactaattaaactacacccaaataaggcaaacgctgaacatagccaatccagctacttctgtgcctcacttttctttctctgaacttctgctggttctgagggctgcccaatttgccagtcttctttgctcaaataaactctgttaaattgaatttgtctaaagtatttattttaacaatggtgaaggagggctagatgttagctccctgtcttccctgtagataacaagcagatggcttcccaatttgggatgcgtgcctaatgagagacaatagggcctgggaagacagtttggtcccacgaggaatcttttcaccaaaattgcaggagttcatgccaggcacccgggagttcatgccagttattagggtggccctaatccagtgtgactggtgtccttataagaagaggaaattaggacacacacaggaataacgacatgaaatacacgacttgaatgctattactgtgtttattctcataaagaaaaaaagtaagttctattccttgctgccaccagaacttaagcattatacctttcagggagaaagggatcggggaaaatctggagctaggatgcaagacagttaaagaactgcctgtggcaaccttttccccaagcaagaagacccactgtgcctctgcaggccagaacaaagctctgcaaagcacaaaagcaatggagtcaggggtggatgcaaacaccctccttggcagtgtcgctggaaaattcaccaccatcatccccttgactagctgcacgagagctccaaatcttgggggcaagttccaacactcacttgccatctaggagacatcagagacctactttgcctgaaatcgctcattgggcaattaatggtgctcctaaggattcatttatgaactcacgattcctggcagtgcttgtttggcaaaagctgtttgttcccaggagccagagacagctctcagtagccagggctgattcaaaattgcatcctgggaagttcccgttcataaatggggttccccagagaacagaccaaaggaatcctggaactcccacagggtggagagttctctggaatcctcaggttgcctttatatgtctttctggctttgctccatacgggtaaggaaaagctgatgggctactcccagcaagcaaggggctgggagacaaagtgtggcagagccctgggtgtcctcctcctgtacagaccttgggcagtctgctcagaaggggccaggacatcaggaaagctgaattgattttattctaatctgtatgatactacatggtgattgcatcaatatacatttgtcaaaacccatagaatctacaacaccaagggtgaactctcatgtaaactatggactttgggtgataataatgtgtcagtgtaggttcagcaattttacaagtgtgccgctctgctgtgggaagtccgtagtcagggaggttgtgcatctgtgagaatagcaggatatatgggaactctctggactttccactcaggattcctgtgaacctaaatctactctagaaataaagtttattgatttaaaaagctcatatgctgatttccactctgggctttatacgacttttctgtctaatttctttacaatgctttattctttttttacaaaccttaatttgaactaatatatattttcaatcttagtttagtagtgcatttcaagtttataaatattctcttcatgtaacactttagctgcaaggcacacatttttatttttggtatcttcttgttgttataaatacttaagaatctctattgttattttctctttagtatgtgacttatatttaggtttacatttttaattcttattattttccctttagttatattgaagttggagcacatggtttctatgacatatactctgaattcagttttttggggggaaatagcatatgattggtttttataagtattctacataaccttaaaaggaatatagattctctagctactgagtgcaacagtctatcctgagtctagctactcaggtggctgatgcaggaggatcacttgagccaggagttggaagctgcagtgagctgggatcacacacactgcttgggtgtttgtatcgaatcaagcttattaattttatagcccaaatcttctactgcctgactaatcatgtaactgatatggcagtttgtgatataattttaccaaaatatcccacttttctctttcttcttgtaattatgtcaattttttacttcatatatttcaaagctatgttgatgagtgcatataaattcatggctgttattacttcttggtatattattccttttttcataatgtattatctattttaatccctatttatgctctctgccaaattctattttgcctgttagaaatattgctgcataagctttcttttaattgcgacttgtctggtatatctggaaacctgaatttaaatcctggctctgattttaactcgttatgcattaggtggaaggctgagacaagccactcaaccacaatttccttactggtgagattaaaatgctgggctggacagatcccaacacctccagctctgacatcctgttagcagcctgttcagcagtcaccacaggggctggttagcacctcctccctggcccttctcagccctgcagcaccaacctcctaccagagatgtctgcatggggtggtgtagtcatatattcttttctttgtaaggttaaactcctctgaaatggaacttggggaaactgtcttctacagcaggctcagggatctcctccttgacattatctagtcctcagtttcaacatattttattttctgactaatcttgtcttgatatggggggaaatcaaatttaccatgaagctccccagtttctgttagctcagtttgaacctctcctttaggttttaccaggctctttaaggcacagactgagtcttctgcagacactctagctatcagagacgctcctgtcttccgagcagccggctcacccatttctctgtcccaaatggcatctaggtgcagggaggcacatcccagcctcgaggcattggaggagcctgctgctccagattagctgcccactgcctagctgtctcaccctggtctctggctccacttgctctgcagctacctgtactcccccatgctgcacaaatggggctcagacgatgctcctgggaggtccccatctcagcccctgggggcacaaatccttcagggtctgtgtgcaactcccactgggtcccaccctcagctcctactctggggtccctgtgcaccttgttctggtgcccttgaaagctccaaccagcaatctcaggcacagtccctgtcctgtggcttccacagagaaaaggccccaggctaggccatcatctgaagcttcactcttagccattgctgcttggccatggctgtcttgggaagttccaaataggagcagggataagcccacactacattgcactccacctcactccatttggggtctataccttctcacggagggctgataacatcctcaccttggccctgtccttccctacaaacctccctctccaatccatccccctgcccacctggaggcatgagaccccctcctcggcctccctgttgagggattcccctgtgcagagcctcagatctctctgcctgggctaagagggcatgtatggtcagaactgctcatcttcactctttatatatgatggcaagtttgggaattccaaactctgtctctctctccacaaagctgggcttgctttctcaccaagtgcttcaagagtttatcttagaagttaaaagctagacattgcctctttctctttgttttcatccataaaatgtctaatcttccccagataacataaggccctggctgaagaagaagatcacattgaagaaggtagaaagaacaggtgcatcaatattttttcaaacatttgctatcctgccatctagaaaagggagatttacttcttttttttttttttttttgacggagtctcatactgtcaccaggctggagtgcagtggcacaatctcggctcaccacaacctccgcctctctggttcaagcaattctcctgcctcagcctcccaagtagctgggactacaggtgcgtgccaccacacctggctaatttttgtattcttagtagagatggggtttcaccatgttggccaggatggtcttgatctctcgacctcataatccacccacctcggccttccacagtgctgagattacaggcgtgagccaccacgctaggctgcttttacttctttaaggggttcaaaagcctcattctgttgattggcagagagggacattgaggtgttctgggaaaaaccccttccctcatgccttatttcatgggtttagacacatggagaagagactatattataggacatcatctgtggtccctaaataggtgtgttctttcagggaagaacacctttgtggaaatatttttaccattttggcactttatgtcatgctatattgccacatactttctactcctacagtaattatgattatccacacactaaggggaaccagagctagtttttaatagccaataaaggataatgttagcattaacggcgctggcttggaaaaaagcctggctgtgcttggatcctaagggtcccagcgagaccttcttctcccctttatttcagacagctggggctcccccactcttatgcccctgaagctgggcttgtgggttacccaactggcttgcttttcaagactgtgcactaggaaatcggtagaatttctctgtgccctggtctcagtccaataagagatgatgagtgtaaaatatccggcacttattagaggtgggtaaataggaaaacactgacatttgccctgtgaatttggcaaagcaggaaagtttattctcctcacccgtggaaactgtacaataacaaatgcttattgttttaagctgctgtttgtggtcgttttttcagcaacagaaaacgaatccactggaaattggaattctagtgctttttgaactctttatcgccccgcctcccattttttaatggataggaaaggtggaaacactcatcacgtgtatcttgtgtacgcactagggaaagtttaacagttgctatgagaacttgcttggacccctgcctttccagccttcctctatgtagttatcagagtataatagacaggacctggacagacccagtaagacagacctttactgctttcatggagaggcaagagatgggagtcacccgaggcatggggaatatttccttggcttgaatgactcagcattgtcctcccatttgaggtccaagaagaggaattatatattttttaatatttttctttcatcactagtactatactgaatgataaaaagaatgagatggatgaatagatggatggatggaaggatgactgggtgaatagatgggtggatgactggatggatggatggaggatggaaggatgagtggatgagtgggtggaggttggatggatggatggatgggtgggtggaggatggatggatgagtggatgagtgggtggaggatggatggatagatgggtggatgggtggaggatggatggatgagtggatgagtgggtggaggttggatggatggatggatggatgggtggatgggtgggtggatggataggtaggtggatgcatgggtggatgagtggatgaatgggtgaatggatggaggatgaatgctgggtggatgagtgaattgagtagatgggtggatggttgaatagatagatgggtgggtgaatggatagatggatggataatgaatgatgaatggatttatggaggtcaagcatgctgttagtctcttgtgagcttgggcccattctaggacctggacttacattttgtttctgtaatggaaatgtgtccctgcccttgcccttgccagcctcctcacctatacccctaaaggtgcaaggctgccagagagcctgtcttgattactgcatcttccctattcctggatcctggatcccaacctgagctgaacagccatgtcttggagccttggctgccattaactgtggtcttacaaatttcctccatggatgaccttggggttaaacctagtttctgcttcccctccatcctcatgggtctgcagttctcaggaatccctctcccctgacctggcttgtctaactgttgcccacccactcccctccctgacaggtgctgtaaaacgtagtctcagcaggcatgcaccacgccatatgggatattgtagaatagtgtggttactattttggggaatacgctcacatactattttggggaatacacttgcagaaacacgatgatggcagccacctccgggtggcttgcatggaagcaggaaaaagtgtttccagctcctacgcttggctcctacgtgctccattgcataggcaaggtcgggggactgtgagctcaccagggaaactgctgtagaatgggattagcccctcaggttttattgaggtgggtatgctgagctacctgacttgctcttttggcaaagttgaggtctcgtggggccatcttggacagctgtctgggcagctgtggaagtggacagtgccctggtctcaggggaggagggtgtcgtgagctgcttcagcccagggctccccgtcactgccacctggcaaggtgggagagctaagcaggccctcaggagcacacactaaagccaagcaaaagcacatgggttcatcaaagccacatgaaaatcgaagaggctggagttgggtttcctccccaatcccacatgaagcacaatgctggaaaagtcattgtgaggagctttatagtcttttttaaaaaattcatgaagattacataattttcagttaaaatatcattttcagcccgagattaatgtgcttctcaggacagggccacttcttaaaggcctagcactaaaaattgcatccatttttgtctatcagattctgctttagatgcattttttcaactgtccctaataacagttctgtgggtgggttattaatattactcccatttaccagtgaaaacaaatgagcggggccacacagctagttaacagcagaaccagggttcaaagtgtgcccggacagctccacagggcaagatgctggtggtgcgacaccctgcaggtcgaactaaggaggcaagaggctcatcgggacctggtgacttcacatggatgttgctgctgggaagagctttcttgcttgtttcagttcaattctcagccccatatcctggctggggtggtgccagaggcccccaggtttgggtgttctcagagctagcaccccatgccatctggcatttggctctgtgaatgtgtgggtgctatttaacctaacctctgcttctcacatgtaacatgggaaagctagcagtacctacatctcataccgtggctgtgaagaaggcacgtttataaagtacctaagccagtgcctgacacaaaataagcactaaataattgttagctgtggttattaatcatgcaacagatgttggttttgttgaagaaaaggtgtccttaatggttagtccctacaggaaaaagccctggacacctgatctgaacagcaacttgttatgattgatgttccacggctgagcacagggttggagacagatcacgtgggtgctgtggatgccgtggatgatggtgatgatgcaggaaatgctgtgttgcctcgacagacttggggcttgagatactactcagcagccctgtcagagacgtcagtgagcacatcagtcttcttttttttcctttttttttttttttaaagacaggatctcattgttgcccaggctggggtgtaatggtgaggtcataactcactgcagccttgaacttctgggctcaagcgatcctcccacctcagcctctcaagtagctggcattacaggtatgtgccactacacctgacttatttatttatttatttatttatttatttatttatttatttatttatttatttattttgagatggagtctccctctgtcgcccaggctggagtgcagtggtgcgatcttggctcactgcaacctctgcttcccgggttcaagcaattctcctgcctcagcctcccgagtagctgaaattacaggtgtctgccaccacagccggatactttttctatttttagtagtgacggggtttcaccatattggccaggctggcctcaaactcccgacctcaagtgatccgcctgcctcggcctcccaaagtgctgggattacaggtgtgagccaccatgctcagcccaatttttaaaaatttttgtagagatggggtctcattatgttgcccaggctgatcttgaactcctggcctcaaataatcctcccacctcacctctcaaagtgctgggattataggcgtgagccaccatgtctgacccaaataagtcttcatgatgacaaaccttgaatgtatcagcccaaaacaactttctgctagatgggggcactctttactacaatatctgtcaggatgaaatgtacatggccatttccccagccaatgcagaagcgctcacagcttgttttctgtatgtgaatgttaatggtgtctctgctggatgaaacacgggttgcagagtgtgtaaagcaagcccctgcagaacctggagggactactcaacacggggtggtgctttacaaagagcgctttgatgtggtcggccacagtcagagctgcccagcagcctctcctgtggcgtctccagtggcatcgcacacacccaagcctgatgtgctgttctcatctttggagcgaatcctagcttatagaatgctctggaaatgttgccagagaatgatgaaaggtgttaatttgactattaaaactcaacaaaagggcctccttgttaataaaggacaatttcagacaggaaagaaactaaaacaacatcgaaactgctactgaagtcatccaactttacagagtgtcttagagggagtcgcatttcttatacagaatcaatactaaaaatagcaatgaaaacaagttggtgccttcttcaaactacacacagtaacttgaggatatcggttctttgggtctgagagtcccaaccaaacactagggcaaggctataagtcagtgccttgttcactcagtatcccataaaatgctccttcatccacacttttggtttttctcccctcatgctcccacttagactagtggtggacattgggcagaggagggctctggccaaatcccccctctactctaccccagcttgtggggctgagcaatttgtccatgcccctgagtcccagctccctgtgtaacagggaacaatagtactagagttgctgggatgactcagtaagacgaaggggagaactagcatctatgtaaaatgcttagtacagtgcttggcaagttctgtctttgacaaacgttagttgctgttatattgttgttgttattgctgtcattgttattattattattgttagtagtagtagtagtcaattcttccagacaatcatcccacctttctggccagcttgactctggtgaggcactttgtgaacattcagaggtgactgctctatgctgcactcaggtcaggcccagtaggattctaaccatttccatccgttcattgagatgtttatcaagagtcgaacgtggcatggaattgacacacgagtgttttagaagcgactctctaatagtataaattgaatattcaaaaaaacgacagtatgttttctcactggagaccttaattaaagaagtgtcttactgactgtttcgtaaatgaatctcgcttcttacgtgaaagccctggataataggtgcgtagcaccgggatggagaaatctctcttaggcctcatcaaccaagtgttcctggaataactgatgggctccaaagtgcagtactgacaacacagggaaatttggggctgtgacttcttagtcgggtggaaaggagaaagaaaaaagcattcctcttcatttctgaatgcctcaacctaaaccaaacagttcagttttagaaggctgtagagtcaggcttaatgaagtctacaaatgaccaatgtgtagaatgctgagaaaaattctccaagagttttttaaaatgcagttatgatattatttaagtatttgagttttaaaacaagcaataaaatatccatttttggccaggtacagtggctcacacctgtaatcctagcactctgggaggccaaggcaggtggaccacctgaggtcaggagttcaagaccagcctggccaacatgatgaaaccctgtctccactaaaaatacaaaaattagccgggtatggtggcgcatgcctgtaatcccgactacttgggaggctgaggcaggagaatcgcttgaacctgggaggtggaggttgcagtgagctgagattgcaccactgcactccagcctgggtgacagagccagactctgtctccaaaatatatatatgtatatatatatgtatattttggatatatataatatatatcccagatgtctcctggctcctgcctgcccatgtcgacatgagactccacagggataaaatgcaacagaggtctctgcattttctgtaatttaatcctctgcggatctattgtatataatatatatataatatatatatttttttttcatttttgacctggccttcctttcttcttattttccttcattcgttatatcgtttttccctcccacaggtttttcattaactagcccaggagttcttaacttttgtttttaactctctttaggccacagactaatattttgaattccatgaaaggaatggagtttctccccagaaaagtgaacaaacgcacaatgcggacctcctggaacctctgagcactcagctagatagacagatggtaggtaggtaggtatatagataggaagagggcaggtaagtaagtggagagacagatagtgggtaggtagatagaagacaggtagaggacaggtagataggtaggtagatgatagatagatatgcatatgataggtaggtagacagatacactggtagatagatgataggtagacaaagagatagacagatgataggtagataggtagatttatttcaaggaatggctcatgcagttacggaagctgacaaccccaaaatctgggagtgggccagcaggcaagagactcagggaagagtcgatggtgcagtttacgtccaaaggctcttacagagacaccgtgaataatatgtgaccactcattcgggcactgtggttcagatatgtccacacataacgtgaaccatcataaggggccagggcctgggatcagagaaccaggaatcagtccagccagggccagcatccttgatacttcttttcttcccctgggctcctcagcccttgctcactgtattaactggcttccccttgacgttctctcccccatgtgagtgggaggcttgccaagagaaagtccctgacgcaggggtttcccaacacatgatgaagccatcttcaggaaagcaggtcaggcactagcgtgagttttatttgttatttgtgtattgcttttggcaaacgacagagcaggccaatcctgggtgtagaattggcacaactccacatcccccaccctcaccatcatggcagtagcccaggttcccacaccagagggagcacagagttctgacggggctccctgcagcctgctttggaggaggcggcttccccggggctggtttctaagcagcacatcgcccattccagcaagaactgggagtgctggggggacactggacctcaaatgatgtatgtgtgagtggcaagagggtgttgtcgtggcctcgaggagatgacagattccgggaggggacagccattcctgcggctgccaggtcaggaggcgaccctcacaactgcttggcgctgtggagggagcagggggcagtgccagctcgttccacccatgtagttctggggacttgtccctaatggatgtttgagtggggaggggtcttcctgcctccacccatcagtgtctgtgaccacaggccctttctgtggccagacactcattgcagccctggcaaaggacagctgagtcagggcattggttcatatcgaacagatgccatcacggactccgttcactctcagtattttcaggtgtccccaagggcccaccccagcctcttggtgaagagggacccaacctgagcccagcccccagagctcctggacatctcctggctcctgcctgcccatgtcaacatgagactccacagggataaaatgcaacagaggtctcattgcattttctgtaatttaatcctctgcagctctttgggggcagttgttaaatggaaatggaaatcaaaacaaaataaaacaaaaagtgccccacatttcctaacagacaacgttgccagggtacacctacttgggaaataagatttttttttttaatccttctttttcacctggacactgtgtccctcaagcctatgggagattactcaacttcctgaaagaaaatgttgagccagaattatgcagagattcagaagtataagggaaagaaacgcaacgcactcaggtatctcagtgaaagctacaagggttaggaactccgtcccctccacatcagaatgctctgaggtgtcagcccagagcatcatcgcatagccacagaagggaacgttaggcagaggcccctccctagccatgttggcctcacaatccccaccagcccatgcctgtgaaggagacagacactgtccaatatatacgtgcccagtaccaccaggccctgtcctttttcttactctctcctgatcctgcaaaaatgatgaaggagaggcataggtgtgtcttgactgtcagtgatgatgggacattctacagtctcatcaattcctaagcctcaggggaccgtggacacagcctgatcctgcctgcgtcctcccacagctccatgcctgctcccagtgtgcttccagaacagcagttttttgttttttgtttttttgacaggatcttgctctatcacccaggctggagtgcaatgacacaatcatagctcactgcagcctcgacctcctgggctcaagtgatcctcccacctcagcctcccaagtagctgggaatacaggtgcgcaccaccatgcccagctaatatatatggagatggggctttgccatgttgcccagtctggtctcaaactcctggactcaagtgatccaccagcctcagcctcagaacagcagctttgacactcggagagccagggctctcaagatgtatatgtcctggcccagcagcttcgacatcccagggggcacgggttagaaaagcatgctgtggggccctccccaggctcgctaagtcaggacctccaggtggaccagcctctgtgctctcacagccccctcacctgctacccccactcgcagagcattctgctgcttctcaagccagagcctgccttgggggtgagcttcagggattgctgacagggagctttggctctgggaacctcccctcaggatgaccttagaaagggctgcccacaacagccaactattggtttaatttttttcttaaggagaaagacgaccgcacaaggcctaggtctccccaacaggcctgcttgaatctgagggctcatcctcgttccctagatggcaagttgaaccctggcccaggcagcccctgtgagcaccacctgggtctatacctgagccagctccactccgtctcactcagcctgctcttgagggttgtcggctttaggatgcaaggagtttgcagagcacacccactgacttgggggttcccaaagggaacactttggcagaagaggcacagaaacccgatccccacaccacgaggattcctccctccttccctttttattcttcccttctccctttcttccttccttccctctctcctttcttccttccttccctctctccttccttccttccttctctccttccttcgttctctccttccttccttctttccttccttccttctctcctttcttccttccctctttccttcatttcttccttccttctttccctctctccttccttccttctttcctcccttcctctcttccttcctttctttcttccttccttcctttttttgacagagaataaatcaagcaaaaaatacagtgacacagctcctgcacactgctgagagcacattaaccttctgcggttgcttccgcttcttacgtagagcttcataagcagggctgaaaatcccacaccacatgcccggcctccatggaacccttctccttaagtttgtgtggctttacagatccacgtttttatacctttccctcactattatgcatccaaagccaaggtatagcattctgttgtgtgttttacatttttacacaggtgtgcattgccttgcaatgatttacttttctttcttttcttttcttttcttttttttttgagacagagtcttgctcttttgcccaggctggagtgcagtggtgaaatcttggctcactacaacctctgcccccggggttcaagcaattcttgtgcctcagcctcccaagtaactgggaggactgtcattctgttgagtcattttgcaatgtttagggagagactcagcagcaaattcggtacaggagtactgaattttctgtgccaactgggacacacaccaccacacccggctaatctttgtatttttagtagggacgaggcttcgccatattgcccaggctggtctcgaattcctggcctcaagtgatctgcctgcctcggtctcccaaagtgctgggattacaggtgtgagccacctcagccagcctaccttttttatttaacaactttttttcaagattagtttatgttgttacattcattttcactgattaacattattttattgtatgaatatacaacaatttatctgtccaagtccctatagatggacaacaaatcggcttccagatttttgctgttacaaatacaatcattcaccacataacgttttggtcaacgatggactgcacgtatgacagtggtcctataagattataataccttttctatgtttagatacacaaatacttaccattgtgttacagctgcttacagtgtttagtacaggaacatgctatataggtctgtatcccaggagcaataggctctaccacatagcctaggtatgcagtaggttctactagttaggtttgtgttaatgtgctctgtgatggttgcacaatgatgaaattacctaacaaggctgggcacggtggctcacgcctataagcccagcactttgggaggccgaggcaagccgatcatgaggtcaagagatcgagaccatcctggccattatggtgaaaccccatctctactaaaaatacatgccgggcatggtggcatgcacctgtggtcccagctacttgggaggctgagtcaggagaatcgcttgaaccagggaggcagaggttgcagtgagttgagatcgtgccactgcactccagcctggtgacagagagactcagtctcaaaaaaaaaaaaaaaaacttacctaacaacacatttctcttaatgtatccttgtccttaagtaatgtctgttattttccattttccgtcacatattgtcattaagtctctgacaattaccgaacacaattaacattgtcgtgtttaagagaaatcatttaccgatttctctaaaatactccttcctagtactgaatttgctgagtctctccctaaacattgcaaaatgactctgcagagtgacagtcctcactatcccatatcttaccagctctgagaattatcacacctaatgatttttttcaatcagatgggtgcgaactgtttcatttattatttgcatttcctgatttttgtgaagctaaacctctcactcacatttattagccaatcagattttttggtgaattatcccttcttttgcccatattgcactttttctttttgatttgcccaaatgttcttatattatgaaaacaccaatcttctgttagtctgtgtctgtctctattttatcttccatttcctgtattggcaatgctatcatctgcaaatgataattttgtcttgttcttttctgcaacgattacttctatcttttccatctcatctcattgtcctggttgggaccttcacgacaatgccgactggacactgtggtagtcccagtctcactgcatatctgcttttaaagggactatttctaatctttgcctgttaaatgttaatatttgctgtaggtttccagcagatagtatttacctggcataggagtcccattctaatattatattagtttgctaatgtctttctttctttctttcttctttctttccttcttttactttatttttttgttgttgttgttgttgtagtttttagacagtcttattctgtcacccaggctggagtgcagtggtgcgatctcagctcactgcaacttccgccccctgggttcaagtgattcttgtgcctcaacctcccaaggagctgggattacaggtgtgcatcgccgtgcatagctaatttttgtatttttagtagagacagggttttgccatgttggccaggctggtctctaactcctgacctcaggtgatccaccagcctcggactcccaaagttctgggattacaggtgtgagccaccacactcagcctgctaatgtatttcttaatgagtaaatgtagaatgtcatcaaatgcttttttccctgcgccttttgaggatagcatgctttttcttctttaacctgtaactcaatgaattatattaatatatttcctaaggttaataatcttgcaatcctcaggtgaggtgtgctgatgtgtgatatacaccgaagcatttcatttgtaaatttttaaaggatgtttgtgtttatgttcacaagtgagattttcttctctccccttgttttgtctggttctctcatgccattctgtggaacagtcttaagataagaagttatcttttcttgggaaatttgataaatttcacttataaaatcatctaagcttggccaggcgcggtggctcatgcctgtaatcccagcacttagggaggccgaggcaggcggatcacgaggtcaggagatcaagaccatcctgtctaacacggtgaaactccgtctctactaaaaatacaaacaattagcctggtgtggtggcgggcgcctgtagtcccagctactggagaggctgaggcaggagaatggcgtgaacccgggaggcagagctggcaatgagccgagatcacaccactgcactctagcctgggcaacagagcgagactccatctcaaaaaaaaaaaaaaaaatcctctaagcttggtgctttttggtttattgatttttgactactgatttaatttctcttatggtcatttttaaacctataagttctatggctatggttatatggttaaaggtctattcaggttttaaatctgtacttgaatcagttttgacaggacacccttttctagaaaaataaccattttgtctaggttttcagatttattggagtaaagttgtccattgtatttggttataagttttaatctttgggacagctgcattgaagtctcttttttcttccttctttgttttctttccttctttaacgttttctcttttttccctaatcaaaccttccagagattgtagactttacttttttccccaaaattagcttctgcttttgttaattctcacagatatttttggttgtctaatttgccaatatctcctcgtttctttcttatttccttacttgattttggtttaactcttttttccaaaagtaacctcttgagttgaacgcttatgagcttttaatcttttttcttttctaatatatttatctaatgctataattttctgtacgctgtgttttcatatgtttttatatgcagtgttcttgtcattcaattctatatattttatgatttttataaaggcaattttttttctttttcaagttcaggggtacatgtgcaggatgtgcaggtttgttacacaggtaaacgtgtgccatgatggtttgctgcacagatcagcccatccccccagtattaagcccagcatccactagctattcttcctgattctctccatctccccaccccctgtcctccaacaggacccagggtgttttgttccgcaccatgtgtccatgtgttctcagcatttagcttccccacttataagtgagaacacgcggtatttggttttctgttcctgtgttagtttgctagggataaaggcttccaactttaaccatgtccctgcaagggacatgatctcattctaaaggttattttttgaacccaaagtatctaggattgtttttgaaggcaaaacattattactaattataactattttacattttgatcagaggatatcatctatagcacaagccagtaaatatttttctgtaaagggccattattgtaaatattttaggctttgcaggtttcattgaatctctgctacaactacagcaaagctgaaaagtgatagaaacgtttgactgacatactcaggggtgcgacctgatcattaagccaggtgaaaaagcgcctgctagaagattcttgaggcagagctagaaattacaccaagagtagacgtgttttctttttgatttgtacctagcagaatggtgtggcaataatttctcaagcattccattcatttcatgtcctaggtagaaataacctagaaagagaaaaaaggcaaagaaaatcaggtgtccatgcctacgtgaaacagaaaaagaaaattgttcaggtatctgtaaccaggcctaggcaaataaaggcaacttacaaaaatacaaacactattaaggtgttttattttgttttttaaggaaaactgggaagggagaataaataacagggacatcaggggcaagatcagttgcacctgcagagttctgcagcttgttagaaggcaggcagcttgagttagctttcagcagccaacccccagagctacatgcaatcatcaaccagtgtccacaaggaacaaacaagcaaggggctccagtagaagaaagggaaggtgctggttggtgttgcaggtcctcttaggaggaccaagttcatatccacgaaactcgtgggctgctcctgcacccccagagtccagttgcaaggccatgggcaccgagacatgctcttcgtcttttccagctctaacctagacagtcttctctttttatggaatactcttctgagaaatatcccaagtgaattactgaatgatgctttgatgagatccttgaggaccatcaaaagaaacagccctctgaagacaaccagatccagtggtgtgcacctgagtctcagcagttcctcatccttttctaaaggaggtgcagaacctgagaccgagcgtgaggtctgagttccagttccattacctaactcgctgcgggactctgggcaagtcactgaccctccctgggcttgctttcctcatctgtgaaatgggatgctacttgaacttccctcatacggttcttgtaaggatgagtgagctcctttataaaactatcggacagtgctcagagcacagtaactactgcaccctatcttctcaaatagacttttttttttacagcagttttaggttcacagaaaaattggtcagaaggcacagaggtttcctttatgctccctgctccctcacaagcacagcctccccaactatcgatatccacccccctcacagtggtgcatctgttccaatcgataaacctacactgataccttattaccacccaaagtctacatccaatttttattagaatgattttttttccatggggcagtacaaacatatcttggcacaaacttattctcaagcttgtacactctattttcttgggataaaggtggttcaaggtgtagaattttggtttttaataagacccattgaggaatgttattatctgaatgtgtgtgtttcctcaaaatttatgttgaaatcctagcctccaaggtgatggtataagaagtgcagccttcgggaggtcatgaggccatgatagtagagccctcatgagtgggattgagaggcaacagagagacccttgccccttcccctatgtgaggtcacagcaagaactgcgcagtctgcaaccgtccccaggtggccctcaccaaaacccaaccatgctggcaccctcatcttggactcccagccaccagaacagggagaaataaatttctattttttaccagccacctggcctacgatattttttatagcggccttaatggactaagacagtaagggagtcaattagcagaggaaatagtagacattggagatagaggacctgggtttggctccaaattctgctgctagtagctctgagaccccagttctctgaagctcaagggtaaataaatgcagtcatagtccccaaggatggtggccaggctaaagtggagttcacaacttattattattattattatttttatttttgacagtttcactctgtcacccaggctagattgcagtggcacaatctcggctcactgcaagttctgcctcctaggttcatgccattctcctgccttagcctcccgagtagcaggcgcctgccaccacgcccgggattacaggcgcctgccaccacgcccggctaattttttgtatttttagtagagatgggtttcaccgtgttagccaggatggtctcgatctcctgacctcgtgatccgcctgcctcggcctcccaaagtgctgggattacaggcgtgagccaccgcgcctggccacaacaactattaatatcctgatggtgcatggctgggtggagcatacatagtaacctcacatttatccttttccatgtcttcccccagcatctctgtcccgtcttaaaagaaaaggtgcatcatttataattttggatggtttggtgcagggaatattatcagggtaggtggcaatttacttgaggagtattgacacgttagcaaatactctttcctttgctgcaatactgggaaagtccataatacaatgggatttttttcttgtagtcaaaagcagttgtacattatttttgcttgtctctgatggtgtcaagtctaaatcacagccatcagctgactcctgatgcatgggtagaaaaggtcctgacaagccccatcttttcctgcccaagaatggtaaacaagttgctccctctagcatcaatacactctctgaaggtggcttcctaagactgtgtgtaccacaacaggctatttctttgtgcaaatgactgcactttaacttttttattattaaaaatgagaatgagtgggccgggcacggtggctcacacctgtaatcccaccactttgggaggccaaagcaggtggatcacgaggtcaggagatcgagaccatcctggctaacacggtgaaacctcatctctactaaaaatacaaaaaaaattagccaggcatggtggcgggcgcctgtagtcccagctactctggaggctgaggcagaagaatggcgtgaacctgggaggtggagcttgcagtgagctgagatcacaccactgcactccagcctgggcgacagagcgagactccatctcaaaaaaaaaaaaaaaaagagagaatgagtggtaggaaaacaagtcctttgtgtgtgtcccagataatttcatctgattgtaaagttgagatacattgggttatgtcattaacctttggtagcttcttaagaaaatagtttctctagagtatctatactgtgaaatgtatttttattttccaagtagaacatgcctctgggattttgagaaaaaataaaaacatacataagttcagtaacatgaatattgacatttgtttttgaagaaaataaagctgagctttcaaaaatgatgtcagctttttggaactcacaatctatagacgattccatctaatctttattgaatgcctgctgtatacaggcaccagtatgtgaaacctttttatggggtaggctttactttatttattcttttatttatttatttttttgagacagagtctcactctgtcactcaggctggagtgcggtggcgccatcttggctcactgcaacctctgcctcccagattcaagcgattctcctgcctcaacctctcgagtagctgggattacaggcgcatgccactacaccttgctaatttttgtgtttttagtagagacggggtttcaccatgttggtcaggctggtctcgaactcctgacctcatgatctgcctgccttggcctcccaaagtgctaggattacaggtgtgagccaccgcacctggccctatttattctccttttatagatgaagaaactgaacacagaggggggaattattcaccaagtttgcatggttactatggggcaaggcaagattcaaactgagcattggtcatctaccaagcccacacacttcccaggtggctgcactgcccttctcaggacctaagggaggctccagacctgtgctaagcagtagcctcatgaggctattgagactaactatagagtaattacaattaaatcaaatcaaaattttaatccctcaattgcaccagccccagttcaagtgctcaaagtcttatggtggccagtgctttcccctgtacagcatgtcctgtagaaccctttacagcagaaggctgtcttagacatggccatttggttgctctccacctctcagcccctcggcttctgctggaaaatcatcaggtgcctctgtggaaaaacgacacccaaagctgagtttcctggtcctggcttaccttctctctgggctctgtaaccccaagtccttgctcttttgctagctttctggttccttcctacagttttgtccatgttttctagctctcggtaggagtactggcctgaaacaagtcaggtcactttctccagcatttcattttccctatgcatctgtccacatgcctttcctttgctctaatccacagagtcttctgttgcctggtggagagtacacctaaccatgcctaaaatttaaaatgtattgtttataaacctcatctagtgattgtctcaatggaagatagccccatgtcatgcatccagaaaaccccattatatccaaatgccaccagcctcatgggcatctacacacacatgaacccacatggacagcaccaaggccaggtcctctcttggcactcacatataatccccccttagccaactctttcagggcttccccaaaacgtgccttgcttgcccatccagggcatcaacaaccgtccccactcagcttcacctgctcgcccctgcagcttcaatctacctatcaatcaatacacccacagtcctgaagaccactgcctacaggacttgccgtgaggatactgttatttatgcctcttgaggctggctgagtttccagattccaagaagccagagcaaacatgtattctaatgtaattacatttattttgtttttattttatttttgtttattacaatgtaataagcatgtaatacaatgtgggaagaacagcttcccaactctttgctgcagcttgttacctggttcccaagtgccactgcttgttcccagagcattccaggaaagcggcctctctctctcttttcttttctccttccttccttccttctttccttccttccttctttccttccttcttgtctttcgtttctctctctctccctatctcctttcttccttccttccctccctccctccctccttccttccttcctctctctctcttctttcctttctttctttttctttctttctttttttcttgcttgtttgcttgcttgcttgcttgcttgcttgcttgcttgctttcaacagagtctcactctgttgcccaggctgaagtgcagtggcatgatcacagctcactacagcctcaacctcatgggctcaaacaattctcccaccacagcctcccaagtagctgggatcacaggtgtgcgccaccatgctcagctaatttttgtattttttgtagaaatgagttttaccatattgcccaagctggttgcaaactcttgggctcaagcaatctgtctgtctcagcttcccaaagtgctgggattacaggcctcagccaccgcatctggccacaactttattttttaaagcatgtttaggttcacagcaaaattcagaggctggcataaggtttcccatatacctcctacctctacatatgcataacctcccacattattaacatcccccaccagagtgataccctggttacaactgataaacttacaccgacacatcattgtcacccgaaattcatagtttacactggggttcactcttagtgttgtaaatcctgagtttaaacaaatgtataatgacacatatccatcattatagtatcacacagagtatcttcactgccttaaaactcctctgtgctctgtttctctccctatccccaaccccttgcaaccacagattttgcaaccactataagaatgtcttatagttagaatcatacagtatgcaggcttttcagattggctccttttatttagtaatatgcctttaaagttcctccacatcttttcacagattgctagctcatttctttttagtgctgaataatattccattgtctggatgtaccatggtttatccatccatttaccctactgaaggacatctttgttgcttccaagttttggcaagtatgaacaaagctgctataaagctgctatctctgcgtagatttttgtgtgtatgtgtatgaacatgttttcagctcctttgggtagatagtaaggagcatgattgccagatcctatggtagactgtgcttagttttgtaagaaaccaccaaactgtccttcaaagtggctataccatcttgcatacccactggcaatgttcctgttgtcccatatcctcaccagcatttggtgttgtcagtgttacagatttggtgattctaaaagatgcgtagtagtatctcattgctgttttaatttgcactccctgatgatatgtgatacagaacatttttttctcatttttttttgccatccatatatcatctttgatgtgtttgttaaggtctttgggccactttttaatcagattgttttcttactgctgagttttaagagttctttgtgtgtgcgtgtgtgtgtgtgtgtatgcccttactgtgaaaaaaatatatatatatattccctttctgtgtatgtatatatatatatatatatatatatatatatatatatatgccctttctctgaatatatatatatgtttctttctttttcaaattttatattagattcagaaggtacctgtgcaggttcgttacctgggtatattatgcgatgctgaggtttggggtatgaatgatcccgtcgctcaggttctaagcacagtacccaacagtttttcaagaaggtgttttttctatgctcagtaggtaaacctaaagaaactgtgttcagcctggccagtcaccttttttcactcagaaggactttccatgctttacccagatatatagaggaaactgtcttttagccagtttcaaagatttttattttatctgtaattctgacagcaactggtatattgcagttcaattctgccactaaccacctggagttagcacggacctcacaggtgaagagcacagtcagtcccgagtgtatgtgtatgaatattcacatagacagccccctccagacagcagccacaagttcagtgggtcccaggccactcacacttttgaccaactggctagtaattcaagggtttccacaatcctgtcatgtttgatcattggctataacaatgcatagaactcaaggaagtgctacacttttgattatagctttacgataaagagaacagctcagggccacccagatgaagagatacagagggaaggcctgggaggatccccaacacagagcttccttgccctctctgtgaaaatagggtgtacctcccttctggcacacccacgtgttcatcaacaaaatcatccctgatgctcagtgtgtggagttttgacgggttcattacgtaggtatgattggccaccaggctgaactcagtctccagcttcccctaccttctctggagcttgggctgggtcaaagtcccaaccctagtatctcatggatggtctttcttctgtccagcccctattcctgaagctgtctaagggctcactgggagtcacctcattagcataaactcaagagtgagccaagaggctcatgaataacaaacgcagttctaccactcagaaaaatccaagagctttagaagccctgtgccaggaagtcagaacaaacaccagacaaatcccttattatagaaaacctttacagcttattcacaggtatatgatgagactcatattcacaaacagaaggatgtcagaatcttattttcctactcaagaataaatcaaataccatctactcctttgtatgacttcctcaaaatctgtccaagagaacaattaaaattgcaagatggcaacggatcatattttttcacttggaaaagataatattgctactgctacctctcctaccataatgactaataacaattgctgatcttgcttttggagcctatactgtacactacttaaaaggcaatgagtcaggtaaaggcaacaaatataagagaattaggcttcagaaaatcattgtaaaagtttgcctcttgaagctgatttccaccaaaagcaaacaacttataaacgctatacatgtacgtcagcttgaatcatgtgcacagagacatgaggaagtttggaacgccaggtttgcaaaacccttagggtcaggcttgagtgaaaatgcaagcctcagagtcaaaaccaatttacaatataagatgcagttggttggcataaagaattcagtaaggcttgaaaaaaaaatttaattaagaaaagtttgggggaaaaaaaagataaatgttgcctggagctttcatttaaattggaaacatcctaaaaagcccctggccagttctggccccatacagctaaaggacctggcaaaaccccagccttcagtaataattaacactcataaagtcacaatgaagttatcaaggggccattttggccatgcttaaaagactaaccacatctgccaaaacaatgacatttccaaactcttaatttttgcaacatgtatatatgtgttctcagttttcagtgtatgcattactgagaggaaaacagctagagagaaagaaaagtgctttttcattaatcaaaaggagactagactgctgtttctgcatactatgcacagcaagattcagagttaaacatcatcattcaaagagttgatgttgaacaaaaaataacagttgaacttattcctgctttacaccaaaaagtgttattaatttttaatttcctgggcatgcagtagtattttctgaattagattctgagagagtgattttgaccatgggatcactagtaaaatatcagctcacaatctacagttatcaacatccagacaaacaagctagtgttagggaatgccagcagaaactaaaacaaaacactcaagaaattttgattctgaaatagaatataaagtaacaatgtgtgaaataagaaataaaaggcagaggtagtaaaaacgtttatgaaagatcaatgagacagattatttttgaagttttttttaaaaaaaactttgtatgtgtatgtgtgtgtgtgtttgtccaaagtcttgcaagtttcatgagaaaaaagaggtagaatgggagcacattcaacttcgttcagtggataaatggataaactctgggttgagagacaaagtcaaaagttgaccttgcccggatgttttgaatccagggctgctgagttaaggaacaagataatggggttccactactaattaaaaacccctgatgcaaaggcccaggccttccccacaccctggttttcctcatccatctctcttcttgtatctcatatattttcctaggagaaaccacgtactttgcaaggattctaatacagtacttctgagttgtaactttcttttatttactcagtaaatatctaatgagtgactactaggtgccataacttcttagcactgggattcagcagaatttgtgctcctggaattatatcctagaaaagaggcaaaaataaacagaggaagtgtaaaaacaattacgatcattttaaatggtgataaatgctttgaacaaaacaggtaatccagtgtgactggtgatgagggtggctgcattaggtggaatggcactgagaagccagactgaagcatgattactgctgagatcctactgatgaggatcctggcatgccaagactggccaaagagaggatggatgcttcagggaaacaggcagaatttcaaacagagggtctataactgtgcgatgggaactgctgtctgtggaaagaatctagaaaatgtccctctggaccatgcatgcagcagtaggaaacagagtccaagaaacaggcaccaaccagattccgcaggcctgaggtgccaagataaggtatttgggttttgttctcagtgtgctgagaggtgcatttgagagtttgcaaccagggaggagtgtaatgtgatttatgttttcttaaaaagtctctttggctgttgtgtatctacatgtatctacaaccacatgtagatacttatgagaggtatcaagggcttctgacattacagggtttgaggtaccctgaagggctctctcactacaatatacatggtaggatcccaggaaagcaatgggaaattttcaagaaggagtgaggagaaagcctgaggtgaaacctgaacagagcaggtgtgcaaacacaaactctgaaggcaaattcttagaattgcactgcaaagaagtcaaactttggacccactgcaggattggagatctgaactcaagctcttaaagaagcagtgtggttgtagtctggtagtatccttgagctcccagcagaagcaacaaaaatgctctatattgcaaagtaacctattttaatcccaaggattttctcagattaagttcaaaaaaatatgagctcacaatctacagttatcaacatccagacaaacaagctaacattagggaatgccagcagaaactaaaacaaaacattcaagaaattgtaattataaaatagtatataaagtaacaatgtgtgaaatgtttgaagaaataaaaggcggatcttaaaaatcattatggaggctgggtctagtggctcacgcctttaatcccagcactttgggaggccaaggcgggtggatcacctgaggtcaggaggtcgagaccagcctggccaacatggcgaaacctcgtctctactaaaaatacaaaaattagctgggcgtagtggtgaacacctgtaatcccagctacttgggaggctgaggcaggagaatcactcgaacccgggaggcagaggttgcagtgagctgagatcaagacactgcactccagcctgagtgacagagcgagattccatctcaaaaaaaaaaataataataattatggagtaaaatactgtaaaaaattacaagacatatttgaaaatgatcaaatgacacattaaggaataaaaatgtaattattaaaattaaaatgttaatgataagctaactcgtggattaagcagagattgaggaattggtgaactgaaagatgggcctaaagaaattgaacaaagcctaatacagggataaggagataggaaatataaaagagaataaagacacagaggatagaataaaatatttaagttacatctatcaaagtcccagaaggagagaacagagagacaagaaaagaggtgatttttaggaatttccagagttagttgatttcatggtgcacagatgcaggaaacataacaaatacccaacgaaataaataaaaagcagtatatatgcagacagattttgcaatatggttgtagaatctcaagtcaaagagaagatcttgaaagcaaccaaagagaaaaatagagcaactacaaacaagcaatcattatcctgacagaggcttctcaacagtgagcatggaaaccagaagacaatgaagtcacatctgaccacaaaattattgccaacttagaatcgtaaaactatcaaaagtatctttcaaaaaaggtatctttcaaaaagaaaggcagcataaacacattttcatttgaataaaaacgtagttgcttttagacatcttctgatctaaaatattctaaaagatgcatttcattaaggaaattctaaaatatgtatttgtttcagtaggaagttcagaaaaagtatctagaataaaagcctgggatacttaaaggaattatgaccaaaagaacattgaagtaaataaaaacaaatattagcagtgttaaataaaaatgtctcacgtgggggttaaaaaaagaaagaagagagctagagtactagacatcaatggcatgtgaacgaggggggaggagatgataggaatttttttgtttgttctgttttgttttgctttgttttgagacagagactcactttggagtgcagtgccacgatctcagctcactgcaacctccgcctctcaggatcaagggattcttctgcctcagcctccggagtagctgggattacaggcacgtgccaccatgcctggctaatttttgtatttttagtagacacagggtttcaccatgttggccaggctggtctcaaactcctgacctcaagtaatccacctgcctcggcctcccaaagtgctgggattacaggcatgagccaccatgcctggcctatagataggagctttatgctctaaggttcatatacagataaagagataattaagatattaatcaactttagattctgttaaatcgtcacagtgacatttcaaaggtagttgctcaaagaggaaaatagatcaataacttccaaactattatacacggaaagtatggaataagacaaaattaaaaatataccaaactcaatctactcccctttcaaagaaagcaagacaaaagaaggataaaaggagcaagaaaaaaattaagttagataattgaagtaaatctaaaaacatcagtaataacaattactataaagtgactcaccttgctcttcaaaaaaaccagactgaatatttttaaaagtaataaaatactttttataagcaacatgcctaaaacaaaagaatggctggaagattaagaagaaatggttgaaaaaatataaaccaggcaaataatcaataaaaggctggttattacatcaaacagaagagtcaagtcttgaagcattattagagtaaacccagtaatcaaaaaagaataaaagaatcaattcaccagaaagcaaaataatgtataacttatatgcgtctaatgaaataagctaaaaacatataaagcaaaacttgatagaactataggaagaaacagcacgtctataattgcagtgggaaacgttaacacacttctctcaattatcaatgcatgaaacgatctgaacaactgtaaaatggtaaatacaagcagttattcaaatagctactaacaagtttgaactcataaaaatatatagaatccagccaggtacagtgggtctcgcctgtaatcccagcactttggaaggccaaggagggaggatcgcttgaccccaggaattcgagaccagcctcagcatggtgaaacccggtgttactaaaaaatacaaaaattagctgagcaaggtggcatgtatctgtagtcccagctacttaggaagctgaggtgggagaatagattgagcccaggaggtcaagactgcagtgagctataactgtaccactgcacttcagcctgggcaacagaacgagaccctgtctcaaaaaaatacacacacacgtatgtgtgtgtgtgtatatatacataaatacacacacacatatatatatacacatatatacacacacacatatacacacgtgtgtgtgtgtatatatacacatatatataaatatacatagttgtgtgtacatatgtgtgtacatatataagcatatagaatcctgtacatctcaaagaatatacattattagaataaacagaagatttgataaccacatactataaaataatgctccataaatttttttaaaatgtagggggttataaccaaaatttttctctaaaataaaccagattggaaaagaatagaaaatatcagagcacatcatactgaagaagaaaagtatcatttcgagaaaattgctttacatataaacatcctaatatatgtatatttgtgtgtgtgatgagtctcaatataaatgtatttcttatatagtcacagtaaaaaatgtttcaaaaccactacctaagaaacttttgtacataggcctctggagaaatgtacaaatatattcacagcaagattattcatatcggaaaccaataagttgttctctcttcctgggatggagcatggacaacactgcagagcagtaagaatgaaccatagatctacgcccagcaacatggatgagccataaaactaatgttgaatttttaaaaagcaagacagtatatatgaacctcaaaaacaaagttaaataacattttttagtgatatacaacatataaatatgtgttaaaaatatttaagtatcaggaaaatgataagttaatttcaggttggaagagagctattgctggggaaaaggcaggataacaggattggggaaaacacacaagtatgagatgaaatcatatgaaattgcctctattcaaaaattgtttaatcttcaaaaatgtcatttcacatggttcaacctaatagctccaagtgtactggtaacatcctgtcacttaagatgagttgtgagtttacaaatattaggtttacaattatgatgcctaatttgaatttgtttatgtattacattacatgtataaagtattacaacattaaaaaaaaaaaacttttcttaaaagagtgcaacaaggtccctggggtccatgtgagagagggttggacaaggttggaaaccagaaaaaggagagacgttaaagggtggaggatttattatagttagttgaaggcaaactcagtaaggctctctgatgtgctggttactgggaatgagggaaaggacagcaaatctatgtcaatttcctctgagctaaatgaaacaatataagatgatgctttcatttggggatgaggagttagggtttgatatgggtttgttttatggtataaaatataccaccatgaaagtgatagatgtttaggacagaaattttaggaaatgtaaaaaaaaataaaaaataaaataggttaccatccccaacccactcaggctaatggcagcagctaaggtactgaacactggttaaaaaaagaaaaagtgcatgagaaaaaaaaagtctatgaattgttaggtagttcacggaaagccctcttgtagtccaaggaccatattatagcaggaaatgcagctagaatcgcttggaaggaaaagctgcaatcacaaataaaatcatcagttgtataatatttttcagtcattacaggaagcaagtatcaaagctgctttcaccaaaaaatgtggggatatggctttcattgtgccccagtgtgaaattattccagttaaaggggtttgcagaatagcaacttgttgttttcttaaaagaaatcctggtgtcatcgacagatgtgagttttactcacctaacgtggagatgttttcaagggtgctgccagtaatgagaaacagtgaattgctgtgaaattttgctgtgctggacttggtaaaggccaaagtgaagtagctagcgtgagtcatgctgcacaggttatttttaaaatactggagaaatcctggttgccacagaactgtgtacaagttgacacgaagattgaatttggtgttgatgtaaccaccagagaagttgttgttgctgctgatgttactgataatgatacccagagactctggccatcgagagatcaaagcaaacagaaagacaaacagtcttgttgtgacctcaaagaagcaactctggaagggctccagatggtaaagaaaaactttgagtgggttgcagagattgtagaattgctttggaaatcagaaagtcagtgcaggggtgtaatatgcataggctcaatgtctgatctagaacactgtgaaaaaatcaagagggcctgtggaaattttgggtttgggtaacatctgcccataaaggactagatgaaactctgaggattaaagctgagtctgaaggggatggcattccttctgtatctgtggcagtggtaggcagaggccatggctagggaccagtgatgcctgggaacactgcataaccacgtagttatcagctgtcctcccctcacaccagacagtgacctcaggatgtgtgagcttccctttgacaggggtctcaggtagtggaccatactttctgcagaagactcagctcagtatgatgcccagatatttggattaagcgatcatttggcaggaggcaaactgtgaacaagcatattgaacacatggatttcattgaaaagaaaatcagagatataatttataagaaaaaatgccattcacaaggcagggatgccctctctcaccactcctattcaacatagtgttggaagttctggccagggcaatcacgcaagagaagaaataaagggtattcaattaggaaaacaggaagtcaaatagtccctgtttgcagatggcatgattgtgtatttagaaaaccccattgtctcagcccaaaatctcattaagctaataagcaacttcagcaaagtctcaggatacaaaatcaatgtgcaaaaatcacaagcattcctacacaccaataacagaaaaacacagagccaaatcatgagtaaactcccattcacaattgcttcaaagagaatataatacctaggaatccaacttacaagggatgcgaaggacctcttcaaggagaactacaaaccactgctcaatgaaataaaagaggacacaaacaaatggaagaacattccatgctcatggataggaagaatcaatatcgtgaaaagggccatactgcccaaggtaatttatagattcaatgccatcgccatcaagctaccaatgactttcttcacagaattggaaaacactactttaaagttcatatggaaccaaaaaagagcccgcattgtccagacaatcctaagccaaaagaacaaaactggaggcatcacattacctgacttcaaactatactacgagcctacagtaaccaaaacagcatggtactggtaccaaaacagagatatagaccaatggaacagaatagagcccccggaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttataccaaaattaattcaagatggattaaagacttaaatgttagacctaaaaccataaaaaccctagaagaaaacctaggcaataccattcaggccataggaatgggcaaggacttcatgactaaaacaccaaaagcaacagcaaaaaaagccaaaattgacaaatgggatctaattaagctaaagagcttctgcacagaaaaagaaattaccatcagagtgaacaggcaacctacagaatgggagaaaatttttacaatctacccatctgataaagggctaatatccagaatctacaaagaacttaaaaaaaatttacaagaaaaaatcaaacaaccccatcagaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggaggggatgtggataaatacgaacactttcacactgttggtgggactgtaaactagttcaaccattgtggaagacagtgtggcgattcctcaaggatctagaactggaaataccatttgacccagccatcccattactgggcatatacccagaggattataaatcatgctgctataaagacatatgtccatgtttgtttattgcagcactattcacaatagcaaagatgtggaaccaacccaaatgtccatcaatgatagactagattaagcaaatgtggcacatatacaccatggaatactatgcagccataaaaaaggatgagttcatgtcctttgtaggaacatggatgaaactggaaaccatcattctcagcaaactatcgcaaggacagaaaacaccacatgttctcactcataggtgggaattgaaaaatgagaatacttggacgcagggtggggaacatcacacactggggcctgtcatggggtggggggagtggggagggatagcatgaggagatatacctaatgcaaatgacgagttaacgggtgcagcacactaacatggcacatgtataatatgtaacaaacctgcatgttgtgcacatgtaccacagaacttcaagtataattaaagaaaaaaaaaaaacctcaagcttctaccaggctctcaaaaaaaaagaaaaaaagaaaaaggaaaaaagaatgccattgcattttttaaggaaaacacttcaaatttctaatttagctgcaggaacaaaagcaagataaaaagatgattttatttatttatttattgaaatggagtctcactttgtcacccaggctggagtacaggggcgcaatcttggctcactgcaacctccacccactgggttcaagcgattctcctggctcagcctccagagtagctgggactacaggtgtgcaccaccatgtctggttaatttttgtatttttagtagagacgggctttcaccatgttggccaggctggtctcaaactactgacctcaagtgatctgctctcctcagccttccaaagtgctaggattacaggtgtaagccaccacacccagccaaaaagatgattttaaatcagagaagacaaattaaaggtactggtaaaaaaaaaaaaaaaaaaacagaaaccaaaaataaaataaattgaaaatcacttataattttaccattcagaaactgtcttttaaatgacattccaatagcaatgagcacatctagcaacccatcttggtttctaaatacctttctccactaaaaagaaccagaggccaggcgcaatggctcacgcctgtaatcccagcactttgtgaggccaaggcgggcagatcacctgcagtcaggagttcgagaccagcctggccaacatggtgaaaccccgtctctacaaaaatacaaaaattagcccggcatgatggcacgtgcccataatcccagctactcaggaggctgagacaggagaatcacttgaacccgggaggcagaggttgcagtgagttgagactgcaccactgcactccagcctggatgacagagtgagactccatctcaaaaaaaagaaaaagaactagggcttttgggagaaatagttgattctatggctagggcagaaaaaagaagatgaagctggaacatttagttacagagtgtaagaaaatgctcaagagtgatggagacttgacaaagggcatgaaaaagagatttgaaaaggcttttgccagctaaatctggaataacttgaatatcaaagtaaataatgacggtaaaggattataaaccttttaataaaacagggaaccatcagttcatacagatataaacacaaaaacaaatacaagtagagagaaaaggaagttttccttataatataacgctaataataaatgtataagtgaaaatgccaaacaacatggtaacaataaattcagccaagaaacatcaataggcgctaaatctggtaggttaatgagtacaagtttgaggagaaactggataatcatacaatttccacataactttccacaaaataccacttagaaagagaacaagaatagcatgaccgtgaagaagctggatgaccttaacccagtgacccaacttaacatcacctgtaatgggacaagctgacatcacaggccacctcacagaaggcaatgagacctcagcattatttctgtaattgcctgccaaaaatgcatcacctctgcccattatgaggaattatcagaaagaaacaaacaaatgagcatgcttcaaaatgtgtgacaaaaagtcagggtcttaactcttctagaatgaaggagattaaagaaacataacaactaaatgcaaagtggggtcctaggttggattttttggctataaaggacattactggtgaaactcaaagggggtctgaggatcggatggtagtattacgtcagtgttaatggttattctgagataacacagaagaaggtccttcagtatttatacaactataaatactgaagtatttgggggtgatgggaatcccagcaacaacttgccctcaaataattccgttaaaaaaaaaaagctctttgtacagtacttgcaacttttctggatgcttggatttcataataaaattactttgaaaaaaatatctacttgagatagtgccataaagaagcaagaacagagaaatctctactattctgttatacagcttggtgccctaccattaatgatccttaactttagatcttcaagcatatttaagtctctaggccttggatgaccatgcagggggttgtgcagcaataaggtcaaccttagtagctaagagagagagagaaaggcagatcatactaatcaagttaagcagtttacacaaaactacaatgtgagttgtcactatttccatttttcaggtgcaaaaattgaagctcagaaaggggaaggaagttggccaagatcacacagtaaacattccagctggaattaaagaccccaaggtctgtgcgctcgacagccctttagcagggtttatctttctcgtggtaaattaaaagccaaagggctacttacgggtagttgtctggtgaggaaagccaagggagtatatgcccaggataaataccatcaccaattgccctgttctgcagcggtaatcgaagatccacaccccttgctgccatccagtgcttcctgaagaccccagggaagtcctcagttgacagaatcttccttatcctgctctccacccttcacttctgatgttggctcttccaaggccttcctttggcacagccaaagcaatactcagtgacagatcaacacaaaatgatgtcctcagaatgctctgggcctctctgggaatgtcatcttaattagaaaacctttcatgacttttaatttgtattggtcatttaagaaggcattgaattagctgaggattcagcaacattgaatactgactcttaagaacctcatttaatttactttgttatttaccaagtacaggtattggaatgtgaatgatgagagtttatctttgcaaatgcatacaagagtttttaaacttacagtttaaaagagtgtctgaggatgtaccgcccagaccaaaaaatatatatatcaaatgctgtaagatctaatatttgtttcctccaaagaaaaagcaatcactgcttttgaaatggacattagctctttttttaagtacttagttcagtgcttgtcacaaagcagatatgcaataacaatttattgtatggataaatgagtgctgataccaagagccgagaaaattgccatcatctctcaaatggtcatgtaccagcttcgtcaaaatgaaagttctttataattaaatttaaaacacactattttatttaggaaagttcctaaattatgagtgccaatttgctaatcttattcaacagtgatatttaaatattttattgatattaaaagcacttttcactaagaaaggtattttgaagttgaaagtgtaaaactttcttcaacaacaaaggaaaagaatgcatagaaaatgttagatcaaattatagctttcaatgttatatttctatttcaaaatttttaattgtcttttttagaaatttttctgggttcatagtaggtgaacatatttatggggtacatgagatgtcttgatacaggcatgcaatgtgaaataagcacatcatgaagaatgaggtatccatcccaagggtagatttatccattgagtttcaaacaatccaattacagtctttaagttattttaaaatgtacagttattactgactatcgtcaccctgttgtgctatcaaatagtagatcttattcattatttctattttttaatactcatccccacctccctctcagcctctcactacatttcccagcctctggtaaccattcttctactctctatgcccatgagttcaatcattttgatttttagctcccacaaataaatgaggacatgcgatgtttgtctttctgtgcctgtcttatttcacttaacataatgatctccagttccatccatgttgttacaaatgactggatctcattcttttttatggctgagtagtactccattgtgtatatgtaccacattttctttatgcattcatctgttaatgggcacttagcctgcttccaaatcatagctattataaacataggagtttataaacaaacataggagtgcagatatctcttcaatatactgatttcctttcttgggggtatatacctagtgggtgagattgctgaatcatattgtagctcaatgtttcgttttctgaggaacctccaaactgttctccgtggtggttgtactaattgacattcctccaacagtgtacaagtgttccctttactccatattcccaccagcatttgttattgcctatcttttggataaaagccatttaaactggggtgagatgatatttcattgtagttttgatttgcatttctttgtttatttgtttttgtttgtttgtttgagacaaggtctcactcagttgcccaggctggagtgcagtggcgccatcttggctaactgcaacctccgcctcctaggttcaagagattctcctgcctcagcctctcaagtagctgggattacaggcacatgccaccacgcctggctaatttttgtattttaagtagagatgaggttttgccatgttgcccaggctggtcttgaactcctgacctcaagcgatccacccgcttcagcctcccaaagtgctgggattacaggtgtgagcctccgcgcccagcctgatttgcatttctctaatgatcagcaatgtcgagcaccttttttatatgcctgtttgccatttgtatgtcttttgagagatgtctattcagatcttttgcccatcttttgattggattattagattttttttcctatagggttatttgagctccttgtatattctggttattcatcccttgtcagatgggttaaattgtcttttgaacttttaaagtttaaattaaaattatttttgccctgtacactttggcattagaggccatgggctccagggctttgctggtgagcaggggacgcagcaggcacatgctctgcatctgcgccgactgttcggcatttgactcccaacccctaagtccactttccccgcttttctgccctgcccaggcctgggaggttcacctctgttttgcaccatccatgctccattgccttctagcttccaggtgaatcctgtgcactagcagcaaagtagctacaggagggagaagttggattatttatttttccttctcattcctcacctctccaactgtgtcaggaatccccaaaacccccaggcttgatgatttgctaggacgactcacaggactcagtgtatagtcttgtttgtgattataatttattccaatgaaaagatacaaaccaaaatcagaaaaggaaaacgtttggaggaaaccaggcacaatccatgtcctgtcctggtagagtcacacaagatgtgtttaattccctcaacaaggaactgtggcaacacttgtaaaatgttgcaaccccgggaaacacagtagaaactcagtgcccaggatttttactgggggctggtcatgtgacaccctatttttctatatcaaaatttcaaactcccaggctgggcatggcagctcatgcctgtaatcccagcactttgggaggcagaggcgggcaagttgcttgaagtcaggagtttgagaccagcctggccaactggtgaatccctgtctccactaaaaatacaaaatctagccaggtgtggtggcacgtgcctgtaatcccagctactcgggaggctgaggcacaagaattgcttgaacccaggaggtggaggttgcagtgagcttagatcatgtcactacactctaacctgggcaacagagagagacaatgtctcaaaaaaaaaatccaaactccgagaaggaaagcaagtgttagttaaaccatattatttgtaccattcagtcacagtgtagccactcttatcagtaaaggtagtaggaaccctccagaaatcttaagttcacagactccagcaaagggccacccttgtaagctggcctttcaaaggacagcggccaggtcttctatgctaacacttttctgcaccaaggttctggcagcggctattttcccggcagtcccagctcttcttaagtgtcctcttctgcagttacgtgctgccagattccaggaacttctccctcctccttattccttcaggttcagattggggtgaatctctgagagcatttcttgttgattgccttaactcaagccacccaactctgcacagagtctcatcattactatctgaaatgtttccagtgaagaaggaggaaaaggaaccagatttaccctccagactgaaatcaccctagaaaacagacaaaatacaggcatacctcattttattgtgcttcacagatactgcatgttgtaaactgaaggtctgtggcaaccccatgtccagtaagtatatcagtgctatttttccaactccacctgtttacttcgtatctctgtgtcacagtttgataattcttgcaatacttcaaaccttttcattatttttatatctgttataaagatcagtgatctttgatattcttattgtaattgtggactaatatgagtgtaagtggattttactaagaagagagaatagggatcacaaatatatctttgaaaaaaattaaaattttccaaatttggtatgaactgtaaacccacagatttaaaaagtcatgaaagcccaagcaaaagaaacataaagaaaaaccatacagaagtatgtcataattaaaatgctcaagaccggtgacagacagaaaatctcagaagccagtggagaacaaaagacacacaataaacaaacaaagataagccagtgtctcatgagaagctacgcaagcatgaggacagctttaaagtagtgaaagaataaatcctttagtttatctagaactctatactcactaaaaatatctttcaaatatgaagatgctttcagacacagaaaatccgaaagaatttatcacaagcaggcctgcataacaggaaatatttaacattcaaaattcaatgtaaaattcaccatattaacacactaaaagaagaaataaaaacatatgatgatctcaatagatacagaaaaggcatttgaaaatatccgacaactattcctgataaaaactcacagaaaactaagaatagaggtaaatttcgtcaacctgttacagggaatctctgaaaagcctgcagcttacacatacttaatgatgaatgattgattctttttccccaaacataagaaacaagattaaatgtttgctccaccaatcccattcaacttttactggagatttgagctctcagatttgagccagtgttataaggaacaaaagaaattttaaaaaagaggctgggcgcagtgccttacgcctgtaatcccagcactttgggaggctgaggtgggtggatcatgaggtcaggaattcaagaccagcctggccaacatagggaaaccctgtctctgctaaaaatacaaaaattagccaggcatggtggcacacacctgtagtcccagctactcaggagactgaggcaggagaattgcttgaaccctggaggcggaggttgcagtgagtcaagatcatgtcactgcactccagcttgggcaacagagtgagacttcatctcaaaaaaaagagaaagaaagaaagaaagaaagagagaaagaaagagagaaagaaagagagagagaaagagagagagaaagagagagagaaagagagagagaaagagagagagaaagaaagagagaaagaaagagagaaagaaagagagagagaaaggaaagaaagaaaaagaggaaggaaggaaggaaggaagaaagaaagaaagggaaagaaagggaaagaaagttattaccagcgaacaactggatatttgaatttttaacaactttattaagccgcatttcaaaaaccatacaattcacctatttaaagtgtacaattcaacaatatttagtatattcacagatacacacaaccatcaccatagaacatttttatcatctgaaaacaaaaccctgtctcccttagcaatcaacccaccctcccatccgccaccccaaacccctaagtaaccattaatctactgtctgtctcagtcaattttcttgttctggacattttatatgaatggaatcatataatatgtgatcttttgtgactgacttctttcacttagtataatgttttcaaggttcatctatgttgtaacatacatcattcctttttctggctgaataacatttcattgtatggatttaatacattttgtttacccaatcatcagtttatgtacatttgcattgtttccatctttggcttattgtgaacaatgctgctataaacattagtgtatgaatttttatatggatatatgccattttttctcctgggtttatacctaggaatagaattgctggttaccatatgacacaactatttaccatatgaaaactatgcttaatagagttattatgtaaagaattgccagactgttttccaaaacagcatcatcttacattcctatcagcagtttatgaaggctcagtttctccacatccctgctatctgatttttttattctagccatcttagtgggtatgaagtcatatcacattgtggttttggtttggtttggtttggtttccctgattactaattatggtgagcatcttttaatgttcttattatctatttgcataccttccttgaaaaaatgcctactcagatcctttgcccatttaaaattggtttatctctttatgattgagtagtaagagctcattatgtattctagatataagtaattagatatataatttgcaaacattttctattattatgtatatatcatattatctatctttttacttttgtgctgatgtactttgaagcacaaaattttttaatattttttcttttgttgcttatgtttggtattgcacctaagaatcctttgttaaatcaaaagtcatgaagatcaatccttgtgtttccttctaagagttttatagttttagcttttacatttcagttttttattcattttgagttagtgttttgtaacttatgccagtaccacagtcttgattattattgctttgtagtaagttttaaagttgagaagtacaagttctcctgctttgttctttttcatgattgttttgttttgctttgttttgctttgctttcagattttttgcatatccacatgcattttagaatcaacttgtcaacctctacaaataaatctgcttaggattctgataaggattgtgttaaatttatagatcagtatgaagagtattgccatattaacaatgttaagtattccaatccatgaacataggatgtttttctaattatttagatcatcttaatttttttcaacaatattttatagtttgtagagtataagttttatgcttcattattgatttaatgcttgtgtccctactaccctcaaattcatatgtttgaagtccgaatcactaacatgatggtatttgaaggtagtgcctttgaaagttaattatggccaggtgcggtggctcacgcctataatcccagcactttgggaggccaaggcgggaggatcacgaggtcaggagttcaagatcagcctggccaacatggtgaaacccatctctactgaaaatacaaaaattagctgggcatggtggcaccacctgtaatcccagctactcagaaggctgaggcaggagaattgcttgaacctgggaggcagaagttgcagtgagctgagatcacacactgcactctagcctgggtgacagagcaagactctgtctcaaaaaaaaaaaaaaagttaattacatttacatgaggtcatgagggtgaggcccccacgatggatatgctcttacaaaaagagaaacagacactggaactttctctctctctctccatgcacacactccaaggaaagaccatgtgaagatacagcaagaagacagccttctgcaaactaggaagaaggccctcaccagaacctgaacatgctgacatcctgatcttggacttcacagcctccataactgtgagaaatatatgtctattgtccaaaccacccagtcaatgatgctaatcttaaatacttaagattaaatataacaaaaaagtgctaagacacacttttgttaaatttaatcttatgtattttatgcttatcttaatttcattttcatattgttcattgccacaatatagaaatacaattgatttttgtacatagatcttgtaccccacaaccttgcttacctcatttattagttgtaataactttttagtgggtttcttagaactttctagatacaagatcatgtcatctacaaatacagatagttttacatcttccttcccagttgggatgccttttacttctttcccttgcctaattgccctgactagactctccagaacagcgttgaatagaagttgctggaacagacttatcttcatgatcttaggagaaaagcattaagtttttcactattaagtatgatattgtcagtggattttttgttgatgcattttatcaagttaaggaagttcatttgtattcataatttgttgagagttttttttttctcatggatgggtgttggattttatcaaatgctttccctgtgtctattgagatgggcatatgagttttgttttttattccattgataaaatgtattatgttaattgattttcagatgttaagccaaccttgctttataaatcacacttagtgtgatgtataattatttttatgtgttgctggatttggtttactacaattttgttgaggatttttgcatttgtattaataaaagatactggtttatagttttcctgagatgtttgggctcacaaaatgagtttggaacttttcccaactcttctattttttggaagagtttgtgggaaaatcgtattaattcttcactgaatgtttggtagagttagcagtgaagccatctgggcctggattttcctttgtgaatagatttttttatgattattaattcaatctcctcccttgctatagttctattcagattgccatttcttttttagtcagttttagtagcttgtgtttttctaaccatttgttcactttatctaagttatctaatttgttggtatacaattgttcatagctttcctttataatcctttttgtttatgttagactagtaataatgtctccttttttgtttcagtaagtttttgctccttttttttcttggccaatctagctaaagatttatcaaacctgttgatttttccaaagaacaaactctattgcttttttatttatgctttcactaatttcctctgtaatattttttatttcctctctttttttgctttggatttattttgctttttttcccagtgtcttaggtggaagtttaggtaattcatttgagctctttcttctttcttaatataggcatttatagctataaatttctctctaaacactactttaggtgcatctcatacatttttgtatgttatgtctttatattcattcatctcttagtattttccaatttcccttttgatttattgtttgacccattggctatttagaagtgtgttgtttatgttatatttatttttgagtttccaaatttttttctgttatttatttcaaattgcattttactgcagtcagaaaccatactttgtattctttatatattttcaaatttattgaggtttgttttacaggttagtatattgtctattatggagaatattcaatgtgcccctgagaggaatatatattctgtgttgttgggtggagttctataggtgtctgttagttctagttggtttatagtgtcattcaagtcttctatttccttgttgatctgtctagttattcttttcagtattgaaagtagggtactgaagtcttcagctgcttttcttgatttgtctttttttttttcatttctgtcagttttgcttcatgtattttagtgctctgttactagtgcttatgttggcataattgttataacttattgatgtgttgacccatttatctttataaaatatccctttttatctctagtaacttcttttgttacaaagtctactttgatataactataagattctctagctttcttggggtttctgtttgcataatgtatcttttttatctttgactttcaacatatttgtatatttgaatctaaaatgtgtctcctttagaaatcgtgccattgcactccagcctgggcaacagagcaagactccatctcaaataaataaataaataaataaataaaatgtgtctcctttaggtagcatatacttggataattttcagtcccaatctgacaatctccacctttgatgtggattgtttgtgtgtttagtcatgtttaaacttattattgatatagttgaatttatgtctgccattttattttttattttttatatgtcatgttatttttattcaatttcttgtttattgctttatttgaatttggcaaatatttttaatgctgcatattaatttatttaatgcatttttcactatattttgagggactttttagtggttactctagggattgctatatacatctcaaaatatacaaatcagcttcagattgataccagcttatttccagtgatacagagaaatgttagtctatacagctttattccttttccttatttttgtggtattattatggctatgcatattatttatcttaatgttataagcccaacaataagttattataattagtgctttaacatctgtgttgcgggaagtcagggaccccaaacggaggaaccggctgaagccatgacagaagaacgtggattgtgaagattttatggacatttattagttccccaaattaatacttttgtaatttcttatgcctgtctttactgcaatctctaaacataaattgtaaagatttcatggacacttatcacttccccagtcaatacccttgtgatttcctatgcctgtctttactttaatctcttaatcctgtcagcctagaaggatgtatatcgtctcaggaccctgtaataattgcgttaactacacaaattgtacagcatgtgtgtttgagcaatatgaaatgtgggcaccctgaaaaaagaacaggataacagcaattgttcagggaataagagagataaccttaaactctgaccgccggtgagccgggcagaacagagccatatttctcttctctcaaaagcaaatgggagaaatatcgctgaattccttttctcagcatggaacgtccctgagaaagagaatgcgcacctaggggtaggtctctgaactgccccccccaccccgggcatacctgtctcttatggtcgagattgcagaggtgaaataaactccagtctcccacagcgctcccaggcttattaggaagaggaaattcccgcctaataaactttggtcagaccggttgatctcaaaatcctgtctcctgataagatattatcaatgacaatggtgccaaaacttcattagcaattttaatttcacttcggtcctgtggtcctgtgatctcgccctgcctccacttaccttgtgatattccattaccctgttaagtacttgatgtctgtcacccacacgtattcgcacactccctccccttttgaaactccctaataaaaacttgctggtttttgtggcttgtagggcatcacggatcctaccaatgtgtgatgtctcccccggacgcccagctttaaaatttctctcttttgtactctgtccttttatttctcaagccagtcgacgcttaggaaaatagaaaagaacctacgtgagtatcggggcaggtcccccgatacatctgtagttatgtttttagttcaatcaactttgctcccaaacacctcctttgtgctgctattggcaagcatatgatgcatatgctgtatttctatatggtccaggcccaacaatacatcatataaatattatttacaccattgttatttaaatcagttaagagatgaaaggacaaaaatttgcatctatgctatttttttttttaaatcaatgttgaccaggttggcctcgaacatgcaacctcgcctccccgagtgccagagcaaccggcctgagccacagcggctccctatgctattttttataattacgtaattacctttactagtgttctttgtttgctcacgtgggcttgaatgacagtcctgaggcacttgatttcaatctgaaaaattttgctttagaatttcttgtaaagtgtaatctgctagcaataaattctttttgtttatcttgaagagtcttcaattttccctgatttctgaaagatgcatttctgaatataagattcttgtttgacaattttttttcctttaagaactttgaatatgttatcccactgtcttctgacctctgttgcttctgctgagaagtaagctgttagtcttactggggtttccttctaagtgacccgttatttctctctcactgctttccagattttcttcttgcctttgactttcagcacttttactatgatgtgtctgtggaactgtttgtagatttaacctgttggagttcattgagtttcctggatgtgtgggttattgtttttcagtaaatatggaaagtcttcagggattatttccttaaatatatgttctgttctttctctctcttttcactttcaggtagtcctattatgcctatcttgctgcatttactggtgtcccacaattttcttaggctctgttcatttttctttattctttgttcttttggctggcataatttttatcaatccgtctttaagcttgcttattctttcctatgctagctcaaatctactactgaacctgtccagtgagttttttattttggttattgtacttttcaattccaaaatttttatttttttataatacctatatctttactgatattttctatttaatgcaaaattgtcatcataccttcctttactcctttaattatggtttcatttagttttgtaaatatgtttataatgtctaccttgaagtctttgtctgataaatataatatctgattactgtcatgggtaatttctgctgcctgcttttgtttcaatatatgactcacacagtcttggatttgaacaccttgtaattttttattggatatgggatattttgtataatatattgtagcaactttgaatactagtgccctcccccaacccccaggcttattctaatttcctggtttatttgtttagtgattgactgtattattttaatgaagtctatgccaccacacacacccacttctgatgttgctcctctgggaggttcagctttagctttacaaacctggaatgacagtggttttggtagggctgtcttcctctgaccacacccagttgttaaaccccactaatttccagctgattaatccattattaacaattcccttaggcataaattgttctacaaactaacccaatcaaattctggctcctttgaagaaacagtttctgaagtcactgtttgatatgtgttctgacactatgagggcccttcccagatgtcttcttccccagttctctcctgcaaactagaaggcctacagtttagcctagatcttgacctgcctcccaatcatctttcaccacaattttcactgttcttgagagaatccttgagcttgaactcttttatcctcttttgcaaatgaagtaagttcctttaggaagagattaggagctgtctgttttatggcctgcttctgccttccagccagagctttgactctgggggctaggacaatggcaagcttctctcccagggacactttcatttcaggttctgaatgcccagtggaggcagggcagaagcctggggtcctcttggtccttacatctcctgatgtggaacaacttccagtcagctggagcaagggtgattatggcaccacccttctcagcatgccatgccaaggtagagtctccattccaaaagtaggggctgggtgaaagaatggagcccccattacctcatggcacttgctcagaacttggaaaggggtaacaggagaagattgcaaggggacaaaagaaaacctttgggtgattatgtcaattgtggtgatggtttaatagaggtatactaaaacttaacaaaaatcctatacatcaataaaactgccaaaattgcagaacataacttagggggagatatttctaatataataaagagttagtataagaaaagttcataccaaaggaagggagaaacaagatactaaaataggaataaattcagtcatgaactcaggtatcttccatctgtatctctagatagaaatcttggttgcagaggaggtagaataatggcagaatgcctggcagagagcttagcattcaccatgtacttgttaatgtttattgagtaaatgtttgttgagtttgttgcccttgggaagttactttcacacccatcactcccctagggtcagtttccctctaacaccaccatgataaacagcctttgatcacaacaggaagtcatattgcattagactcaagagtcattcagcacatcttccttacattgccttcgtcataataacgaagaatgccgacccattacatagacacaatatagcaataatatttagcgccttatctttttttaaatctgaccatctcaaaatggagatgataggttccatataccttccatgtatttccagttttaagaagctttaagaagtcgagaataatttttaaagaaattacattagttaataattttccatgacttggctcctactggagcctttcaattctacatgcgtcttttttctcagccaggctggtctctgtgttgctctaaccatgcctcattatagtaatagccgtcatttcacataatctaatgaacaccatgcacatcatacacacttcacatatgtcagcaaaaatcctcacatccaccctcaaaggcattaattattccccattttacaaatgtgaaaattggtgatcagagaaattaactaacttgcccaaactctctcagcaagtaaaaagtttctgtctgaccctccaaacgtataccattgggctctctctctgtctgatgttcagatttttgtctctgcctttttcctcctgccatttccttagtttggatcttcctttctctctttctttcaaggtcctgccttcagcacaaacccttctccaacagtccaggccccaggctcctccaagtacagcttgccaattccttgtctggcaagggaaaaggagggagagagagagagaaatgggggtcagaagtgaagccattagatgccaggcatagtggctcacacctataatcccagcactttgggaggctgaggtgggcagaaaatcacctgagataaggagttcgagaccaacctgggcaacatggcaaaaccccgtctctactaaaaatacaaaaattagccagtcatggtggtacatgccggtaatcccagctactagggtggctgaggcaggaaaattgcttgaacccaggaagtggaggttgcaatgatctgagatcatgccactgcaccccagcctgagtgacagagtgagactccaaaaaaaaaaaaaaaaaaagaagaagtaaggccattaagaaagccaggaggtgaggagtaggggatgaagagccaatctcaagaaaaggagatgaaactttgtctcctctgcctttcaaaatgctgtagcctgatcttgcttttgagagcaggtaaggaagatgggcaagcagaggaaggaaacgtgttgggtggaagattcttcttcacccagaaatggcttcagcactcaccaggaccagaacccaggctttgtagggcaggaatgaagggcgctagccaatttccttagcctctgcttcacacagctgtgggattactgatttctttgtccattttgttaattaaactaaaaataatttgccatcatccatcatgctttcaagagatagtctttagctatgagcatctgatttggagtagcagaggaaatgcacactctgttaatcaaatttcaaaaaccagaatccagtgggacctttgggccagcaaagtggggctaaagcatatatgccctgttgctgcacttaggtagtgaaccacttgaggaaaagaactgctttgaaaatctttatttcctgaatctgcagaggaggccaggagaactttctagggatgagggtgatgttctatatcttgatagaggtggtgtttacacagatatatagctgtcaagtcatcaaattgtacacttaagatctgtactttttactgcaggtaaattctaccttattatggctaatggaaagaaagaaggaaagtagaagggaaggaagagggagggagggaaggaaggaaggaaggaagaaaggaaggaaggaagaggagggagggaaaagaaaggaacagaaaggaagaggaggggaagggaagggagaggggaagggaggggaggggaagaaaggggaggggagagaaaaagaatcctcccacttctgtaaacgtaggtttgctgtattagaaatcctggttcccattgggcagtgcttctgtccaggagccaagtaaggattctgctgcacctgcagctgcaaatgccacatgggcactttgggctgctcttacctgtgagcccacacgtggtgaaaagactaactgcatgatggactaattgaccctgactgtcatgagaagatggtgctgccacaagtgtgaatgggaggagaagatctggaatgcagggagtcagtggacctctcttgaggcttctgtgtggcaaacaagaaattgcagccattctgagcttcaatgagagtaggtagaaaggggttgctgtgctggatagtgaaaagccaagatgaccatctgaaggtcagtcaaaggcttcttgtcaagaagcttccaggtttcctgatgagatgtagcttgagagtcacttcctttccaatggacaaagtgatggaacaagtgacctattgtagaattagtctgagggtttcacctacatttgccattatcctggcacaccctctccatctcagggctgcgccacctttttgtgtctgtctgatacaggctaattgctctctgtgtacataggcagaacaggttactgtaacaagtagagactgctatggagatttcattaaggttgacacattcatttcaactggccaggagcgtcagaccatatcccagaacactcaggcattctcaagtactaacaaataatccctgtaaatcactcacttccacaaaagtttaaaataaaaatagaggtagaggaatctttctccaactttttcctgatgctcttttctattctagtgtgatcctgctctatgttttccaatctcatcattcttgttcattgctggtccactcagtccttttaagtcaacagttataagtgtgcttacattctattagaatgagatctgatgacagggcttatctaaggctgaagtccctcaaggacttcccttccccaatctctctcacacatcaataagagccgcaggagtggctttattatgtgaatttattgtgccttctcttgaagaatatcatccaatgctgttttaaaattgtatctttcaaatgccatttgaaatggttataaggcatagaacaatataagctatggcatttgctaataagcattagcatggagccatatgctcccaaaatatattacactttccacaaagaagtcagagacagagtttatcaaggatagataccatacttctttattccctaatagctatagctatatccttagggttctatgctatttttattttgaaactcttaaatatgcagtctatttcatcccataaacatattaaagactaaatttaccacaggttgtcagactagaaaaagatgaatgagactctctaaaggcaggcaagctcactaaaaaaatattacccaaatgaaaactctgggcaacagaatagtaaagcaacactctttaatgttacttgatcatttggtcactaattccagaggatatttggtaaaatgttcaacagataatctgttaaatgagatgaaagcctgggtttgagaaataaaagtgctctctaaagttgtttgagtggaaactgtagggaaataatgagagagagagagagaagaagaagaagaaaagaagaagaagaaggagaaggagaaggagaagaagaagaagaagaagaagaagaagaagaagaagaagaagaagaagaagaagaagaagaagaagaaggagaaaaagaagaaaaagaggagaagaagaagaagtagcagaggaggggaggaggagaaggaagaggcagaggaggaagaggcggaggaggaggaagaggagggggaggaagaagaggagggggaggaagaggaggaggaggaggagaaagagattacatgcctgtaatcctagcactttgggaggccgaggcgggtggactgcctgagctcaggagtttgagaccagcctaggcaacacggtgaaaccccgtctctactaaaatacaaaaaaattagccgggcatggcggtgtgcacctgtaatcccagttacttgggaggctgaggcaggagaattgcttgaacccaggaagcggaggttgcagtaagccaagattgcgccattgcacttcagcctgggcaacagagcaagactccgtctcaaaaaaaaaaaaaaattgaatattttacctcgtcttaagagtttcatgtcaatctggcctttatccctttaaaaagggtctttctttttttttttttaacttctctctgggagtttccagaaacctcttttttcctttggtgctcataaatttaatgagcatgtatatcagttggggccatttctcattcactgcactcaggaatcagcatgccctttcaataggggattcatatcattcagccctgggaatttcctttaattttttaagaaatataattttgggccaggagtagcggcttatgcctgtaatcccaacactttgggaggtcgagataggtggatcacttgagggcaggagttcgagaccagcctggccaacatggcaaaacctgtctctactaaaaatacaaaaattagctgggcatggtggcaggtgcctgtgatcccagctactcaggaggctgagacaggagaatcccttgaacccaggaggcggaggttgcagtgagccaatatcacgccattgcactccagcctgggtgacaggagcaaaactccatctcaacaaaaaataaataaataaatataattttgttctcttaattttctctgttcactctttctgaaaagcctgatgaattggttttctatacttcctttgcttctctaatattttccttctttttgctctgactctaaggagctcattggattttccaggccttctattgaaattttttttaaatcctaatttttctttattaaagatctcagtttttttgtcacatttttgtaacatcttgctcttgttatctagatatgtttccaaaatctcttttaattcatcaattaaggggatttttaatgtcttcggattctcttcttcttttgctgtcagtttttctgttgcttgtcttggttttatgccttttatatcaaggcacataaaaggcataaaaccaagacaagcaacaaaaaaaggattgatcacagaagtttctccttatgtgccaattggtcttcagttgctcagttctagttaaatcaaaagaccagggtggctggtgtggtttcctctgctgttgagaacattagtctgttttccatcagtctcaccactgaatgggaattcttgctggatgctctgggcagggcagggcatgacagggcaaatagactggtgggctttctttgggtaagcagaaaaggaactggcattgacactgggctctccaagagtcaaaatgagaaagacatggtacacagactcccagactagaatacatattattttccaattatgttttagcataatttctttaaaacagagccctctgttctttggtgggagtagcatcctatccaattttattattgccattgaaaagaaatataattttaaataagtagttatcattgctattctaatttgtaggtaacacagtataatagaattagctatctaatttacaagttactgaataatatgatttttaaaaggaaacatatcaaaagatgtgaaagaaaagaaagaaaattttaaaataaagcaacataaacagaaaacataaaataagactgaataaatagataacacatatgagttatcataataattataaatgggttaaattcatctaacatgattcaaaacaattttagaattatccatcttgggttcaaaaccaaagtttgtcgacaagtattttacttaaatttactatactatctgttaggctactgtctcccagcttcaagcccatccttctaccttcagtatatgaggctggggcaggagctctgcaaacacatttatgctctatcaatagaaggcactaaagggatgactgaagcctggagtagaaagaaaaaaatgttttactttttcattctgagagtgtaatttgttccaccataagtagtttgttcctgaatgttctcccaacattccccaaaccagtctcactcccctgtaaaacacagacacagacacacacacacacacacacacacacacacacacacactttgaaatgccagcatttgttcttttgttttctgcatcaggtccctaaaatggcatttaaaagataagctgggcagacacctctcctcagaggtctaggccccagactcaaggggtcccctcctctgagattttaagttttaagaagtgcagcttctttcctttgttttccaggttctatgggtggtagctgcttccagcacttgttacttccatgatacttagagttctctttgtttcctttcaattacctgataaactttattcctacttaacaagacagtgctgtcttatcttctaaatgtcattgtagggacctgatgcagaaaaccaaagaacaaagactcaagtaacttccagcttcctatgtgtagaagtgaaagaggtgaataagtagactaatccagagatatgaatttgcaggctgggagcagggattgatcccagaagtttaacatgatagagagtattgatatgatacattatgtggcttgaacaggatagaaaagaagtaaatcaaagccaagaatcagctgacagactggagaaaacttcaggagtttagggtgatgaggtttgctgaatattaaattctggcatggtgaagtaagtaagaggaagaacagatagaaaggtgtttgcagcctatggacagttcagtgttgaagcggtccaggaaatgacaggatcaaagctgtggaattagagttgagatggaggcgaaggccagtaaagacaaggagattgttctacttaaaaatttagcggcttaaaatgacagtgatattttgcaattttgtgagtgaagaattcaaggattaaactgggcaattcctctggtctatgtgtcagtcacttgtttatattcaattagtggctagtctggcttagggagctcaagactgcttctctcacacacctggtgccttgtttgagacaactaggctcagctgagctccttttccatgccatatattatcagaatctccatgtatacactcttgtaaactagtcagacatggtagctcagcacttgcagagaccaaaacaaaagctttaaagactaaacctataattgcataacatcatttcctccatacttgattagtcaaaacagttatgggacagtccagattcaaggagaggagaaaaggatcccactcttatatggaaaggatgtcaaagaatttgtagtcaactttaacctgccacagaattcctactaagataggagttagctcatctagataaaagataacatgagttggacttatgagggagacaaaggaaatgttcccaataaatgtaggagagtagcccaaaggtgagtgacagctacgagatggggcagagaacagtgtactgggatgatattgcctctgtagttagctaacacagttactttcacctgtgagagagggtgggtgttatgggctgaattttgtcctcccaaattcctatgttgaaatcataacccctgatacttttgaatgggactatatttgaaaatagggtctttaaagaggtaattaaattaaaataatgtcactgggatggccctaatctttacaagaagaggaccttagtacccatacacacacaggaagaagaccatgtgtcttagttcaattggtgttgctataacagaataccaccaactgggtaatttataaagaacggaaatttattttgtcacagttctggaggctgggaagtccaaggtcacagtgctagcagatttggtgtctggagagggtccagtctctgctttcaaggtggcaccttgaacactacatcctccagaagggaggaacatttgtcctcatgtggctgaaggcagaagagcaagcaagcttagccctgcttgaagcctcttttatgagggccattaagctgaatcacaagggaggagacttcatggactaatcacttcttaaaggccccatctctcaatactttcactttggaattcacacctgaattttgaagggttacatttaaatcatagtattatgagaagacatagagaaaagatgccatctacatgacaaggagaaaggcctcagaaaaaaaaaccaatcctgccaacatcttgatctcagacttctggcctccagaacagtgacaaaatcaatttctgcctagaaaactaatgtgataggtgatttttgtggggtggggagagtgtccacagcacaagaggttgcagtggcaatgggagattggttacgtatggtggaattgaccaagcaaatgtattcaagacactgaaagccaagtttcccgctgtcagagaaggaaattaatacacagaaaaagaaaattagaatgaaccttccagttttgcattggaaattgagatattaggacaaatctatgattttcaatatataagtaggttgatagatagatacatacatacacagagtaggatacaggcatgtaaatgcttatatacaaatattccttagctctctcttcactgaaagagtctggaaggggcaataccttaaaagcgatgagcacatctagaagccagatcttggtatttaaataccattctctactaaaagaagacttggcttctttgagagatggccgattctagtactagggcagggaaagaataagaagagcctggaatgtcttgtgccatcaggaaagaataaagcaatcacagcacactgaaagcttaacaaaaggccacagaagccagcttgaaggggctcccattgatcaaatctaaaacaatttggttgtcaaaatacatgctgaaaataacagattataccccattgagtaaaagaggaaagcacaagtccatagtgatagaaataaataagtaaataaattaaaaattgaggacatttccatagttccaaagtagattcccccaaaatacttattaattacaaaataaaaaagagtaccttgatagtgaaggaggctggcagacaccagcttaatcaagagatcaaagtgaacattgtaaggaatggggcaaatcaagatcaggtgctacctgctagtgtattatgaggacatgacataatttctgtgggattcttgcccaaaatgcagaacctgaatcagattacaaaaaaaaaaaaaaaaaattcaggcaaatccaaactgaaggacattctgtaaaataacttgtgtgtaatcttcagaagtgtcaaggtcatgaaaatcaaagaaatacaaggaaaagggagttgttccagattaaccaagactacgagtcacgtgacacatgccctggcctggatccttttgctataagagacattatttgcacaactgatgaaatgtgaatgggtctgtggattacaagcttgtaggaaatcaatattaatttcctgcttctgatggatgtattgtgattatgcaggagaatgtccttgtttgtaggaaatacacactgaaggattcaggtgtcctgggggcatcaaatgagcaaaacacgctcagatggtttaggaaaataaaatagtgtatttgcattgcatttacaacttctttaatgtctgagatttttttacttaatgaaattaataacattgatattctttacccagaataataaatggtatctatttttagtatcagtcaaagtcaagtcaggggacagaaactaacatctacttaaatagagataatcgaatacaaacaactggcaaataagtaaaaagttattaactaggtaactgaaatggcaataaaagaactctgaggtaccacaaatgttgcatttgcaaaatgcagctaccattcctagggctagggaaataaaagaaaaagtttggaattattaaaacttagaaaccttgaggttgatccccatgggcctaggccccagacctctgaggaatctgagctcaaaagggagagtcagggacattgccatatagatgataagcatgtcaattctctatatctgtgtaaaaaagtccaacaaaacttaggctcttagaaatttatttttattatactcattgattctgtgggcactttagaaagaacacgataaggtggctctgtcaatcattttgggggcctcaattggaaggaccagaaagctgggggtgacttcgtgggtagggtcaggaatctcaagcacatgtggtttctccatgtggcttgggcttcctcacaacatggcagccttggatttcttacatgtcagtcagagcttcaagagaacctggaggtggaggctgtatcacctttcatgacctaacctcagaactcacatggattctcttgcctgcctggatttgagcacaggaaatacaggtactgctcagcatttagggaacggcaaggtcaccttgcagaagagcaggtgtgatgaggatgtagctgtctttggaaaatatagcctgcacataggtaaacttacaggtgtcatcatggaaaaagcagtctgcaaatctcagactgctatgacaggaggttaaaaccgaagcactaagacataatagaaacaaaattacaaattcagatcttcaaaagagatggctcagagccagtttgacaagtcttgagcccctctacctcagcaagggaggagcgctggagaaaagaagattttaggggaagggttttgaagagagcttggggaagaagtgggccctgtctctttcactcctgtctcctgaggggcttcagccaggggaagcatgagcatgagagtcttggggaacaccctggaggggagtctgattcctacccagggaagcctggatgacaggagagagcagtgttgaagcagtagcagagttgggggaaaggcaatctcctgccacgcttgggaggaaatgccccacattcaaccaggagaggggatgctgggtcctgggggcatgattctcaagacctggagcagaattcaaagttaaagtagtggttgggcactttgtcagttctgcctagaagaacctaccggaataggtcatgggccctaaaaattccaggctacgagaggggaacagcaggagaacgaggcctgggtgcgtggtggcctccaagggactccaagcaggggcctctgagcccccctcccagaagtttccatggagttcactcacagaagaaaggacctaagagttaagtaactcacccagggtcgcaagtagttagtggcagcactttaagcacctgccaggcctggaggatgcaaagacagattaagatccctctatctcaagtataactccctggtagccccctgctctgcctgcctgcaggaggcagccttggccactggtgaagcatgggttgtacaataaagagaggccgatggtgccttgtccactcccattgcttcccctcagtgtgcccggctgcagtgggcagagggtctgatcccatatccaggtcctggactttattcttgtctcagaaaggacatcccaattgccaagccaaggcaagagtgggtggaaaggtcacagggcctgcccatgttctccggggcagggcaagtttgcccctatgaaataaatcacaaagcagcagtggaacataaaagtcaaactgggacattcttgtggaacaggctgggcgcagcctcagggaattccatgtatgggtcacaggacaggccgcccagaggtgctagagggctgaaacagctggctagatgaaacgaaagaaagaaagaagtaagcagagaagaagtgacatccactaagaggaaggtgctcccagggccagcccctctcagacccgagcaagtatcacaaccctgtctgggaggaggaggcagaagaaggagcccagagaggcttgcaggcctttgcaattgtgcatcttagaccagagttcctcaggctccccatccaggttcagagccaacacggtggcagctgctcagggccgcctgttcaaacacagatcactgagtcccaaaatcattaagtctgggcttgacctgaaaatttgcatgtcatccccagatgaagctgaagcagttggaccagggaccagagtttgagaaggaacactgattatggtgtggtgtagcagcaaggggctcacctcgtgcctaggaatcacactagtttattttaaacactggcatggacagtgttaagtagtgtacagctttagtagaaattgaagattaatgaaaatactgcagaaaacacacaaatagatcatgtgctatatatgcaatcatcggcctgtaggccctaagcaaacactgctcctcctgggggcagcgcctgggagggaagtaacatggccccaagaagttcgacaggcctttgatgctatgcaggacagcacaaagctcgccagtttcctccatctaggtagagagccaagacgggagtggctgaagtaatgactgcctgctgaaatgagaattctttcatttggtaaatcaataattacaagcacactggggaaattaagcaaagaaaattacatcactctagtgttgcactagaatcatacatgcctacaaataacaaatcgggaattcccccagcagttataaataaaccacacacattgcacacttgcaaagggatgtgagtaagcagagtgtttgctcctcatcaatgataacacacatgtgagctggttgtaaatatgaaggttgtagcagctacaggaatcattgctttaaattttctgtagtgtgcgtatgtgtttgtgtgcatgtgtgtgaacgtatgtgtgaacgtgtgtgtgtgttttcctgtatgtgtgtgcatcaggcatttcccagagagaaagcactatctttctctccagggaaaaaaaaatcattgaatggaaagaaatggcaacaaaccacttggaaatctaaacatccaccttaaggatcagttcagagagctgaacagaaacgctccagcccacagaccccatcagtccacgtgtccacttccttccctcgtggttactctggtccttcattactttctgctgtgtaaactctagcccttcagactcactcacctatagccacgagccttagcaataaattgggtggggtgggggggtctctttcattttagggacatttcaggtacaagggaatataattattacatactcatgccaaaatttgtatatttttaagccatctgcatcttaatttctaaagttaatatcctaattttataggaaagaaaaagaggcaaagttggagaggtgagtgttgtccagaagttgacccagtggaggctgggggactgtggtggactcctgggctccagacgccagatgcacactggtcctgctgcctgtgctgcccatctcaggcagactcacctcttcttcctccatgctggtgcaccggatctgcccctcaacaccaccttcaaggccatcactgatggcatgaaggtttgcttagcatttctccagccacatctccataagcttctaaagtgtttgtgcacgtgtacactcatgtgaaagcacattgagtcctgagagtgggacttacatacatggcactttccagagtggagggacacagagggctaaaggcctggggaggagaggtaggcctcagcatgctcagcccagggccatttgcctggagcgttcaccctatccaatgctatctcccctcttcacctgccatcacctgccatctgatggactctaaccgccatgccggcagagccaggtcaagggatgggccagccagggatgtggacaggaccctgatctaacccagacataaacaccactctgggaagcgaggcacctccagaagagtaaggggtggaagagatggcattggccagaactttccccagatatgtggcttaagaggaaaacactgggaagccatccgggcagcaaagaagaccccaaagaacagagcttgaggaacgaagagaaatgaactcctttgaaagacatttcttctgagctggggccagaaatgaactgctcagggaaatagagatgggtgaggcagaggtgccatccgggacctcttttctcatgctccaaggagtactctgcctctccggatccacatcaagtgttactcaaagactcccagctggaaaggtaccatgtttgttctggccttgccttccacaagttttaggctggtaccaaatgaaagcctacggcttcctccctaatggcggaagatggcgcacctgctggccttgtctgcatcagcagagggcaccgactctccttctaagaggcactcacggagtcttgactctgccaatccaggctcactttccattttacgcctgcaggtttacctgattattaactgcaccctcactctgcctcccccaccaccatgcgagtattagcatcacctcccaaagacccc

SEQ ID NO: 80 - DNA, 11475 bp, Homo sapiens
ctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgggactcaactgtgaggtgtatttgcccatcaaatgaaattattatgaccagttggatataccttactttactataaagaaagacccaggctggagatacagatttcaaaaacaacatacatgggatgctctgaaagtctgtagcccagagaaagtgtgtggggagagaagacaaaaatactaagcctaaagccccaagaaggctgggaagtatctaaagaggcaaaagaaaaccagaagtgtactatacagagaagtcagggaatgagttttcaaatgagtaaacaatggtgctaaataaaagagttgggatgaactgaaaactgaatcacatctattggatataaccataaattggtgcacttttggccttgggagaagcagtgactgtgagtgatgagtgtagaaggcagactgtggtgggcgggagagtaagtgggaagtgaggaagtggagaccatttgcatagatttctctttctagaaggctggctgtgaatggaagacataaggtggtagctaaaggcaaatgaggaggggatgagtttggagagacaaacacttatgggctgaaggaaaagaacaggagagaggaagatacttaagtcaaaagaagaagttattaatgacattgtattccttaaaagattggagaggatggggtaagtattaggcaggagaagaaacacctgttcccctaaggcaggaagagatgcaagaatatatgtgtatgtggcacaaaagaagaaagtctgaaagttatgctctttcttgcctgatgatctcacttgtattttgtctttaaaatagtggatgaagctgggcacagtggctcatgcctataatcccaacacgttgcaaggtcgaggcaggagaatcacttcaggtcaggagttcaagaccatgctgggcaacatagcaagaccccatctgtacaaaattaaatatatatatatgggcatggtggtggggtgcctttaatttcagctacttgggaggctgaagaaggagtttgagtttggtgagtaataattgtgccactgcactccaacctgggaaacacagcaagaccttgtctaaattaattaattaataaatagtgaatgacataagaatactgaggttaaattgggggcataaacaagggctctgagagttaaaaaaaaaaaaaaaactaaaaagctaccgcaaggatagagaaaaggaggagatcaacaagagaacttccaactagtgtcaaagacccagccgatattggagaacatagatgggggttggtgcccatttgcactaggtgtggattatgccaactgcagatggctattcccaaggttgtaggaaagatagttgattttttttattcagatctaggggtctataccagaccagtcctttcctcacctacatcttctacaggacaatgattatagcaacagcagctaccagttgctgagtgcgggttatgtgccaggtgccttatatacaatatttttaattcttagaatagtgctgaaaaactatttccccttcatcctgagaaacccaggtcccagaaaggtgacatagttgatccaaggtttcatgagcctgtctgactccagatccctggctctttctctataccttgtcacaacctttgaggcttgacatcagctgtcatttcctttctgagcatttgcttctccaagataaacagttccaggctttgaacaccttcttatggaagcttctttccagtactctcctgttttccttcccaaattgttagtttcctgttcttgaacacacatgtatttacatatgtttttttcaaggtgatgagtaccctacggaaaagccaagactcctcaataaaaagttcttgagaaggactctcttgagggttttccccaagggcaccttcacatgttttaatctagtctcctacctaaaccaatgtgctaattaagatgctctctgaggagccaagaaagtagaacctgccattatatggagcttcaccacctctctggctccccttgcaaaaattgatcctgtgctccagaaagaccaaaccatttactgtcttatgtattttctgtcatgttttctgctttattcatctgctgatctctctgcctaaaatatccattcctttgtccttgcctaacaaccatttacccttcaagattcaactcagacatcatctcttagaaaccttctcaggtagtctggctacatcaggtactccttgcacttcatgcttcctctatcatcacacaggacttgtagggcacagtgattaagagaggaagctaatggactcaccagtcagactagacaagacctgctacagggcacttaatgattgtgtcactttacccctccatgttcccatttttcagctgtcagtggaggatagtgaatgtctatctcataggtttgttgtgaagaagaaataaggtgatccacataaagcacatggcacataatcaatggtagttattcttataacatgtatcaaatagtactacatttatgcttatctttctcccaccatcccataagtaccaagagggtaggaacagcatccaatttatggttctactcccagcacctcactcagaatctggcacatagtaggagctcatgaatgaatgaatgaatgaatgaatctaattcatctcagtgtgtactgtctttgggatcacattatctgaaattacctacttaatttccattatatttagagtgaagatgaagggtaagatatatctttttcaattaaagggcaagaggcctctccaagaatagcctgatgacatggagatttatggatcaagtgccaggctctcagcagtccatggacagttggccatgcccaactggaatatggtctctttcatttagaaattgtcaaggccaagaggccaggcagccaggagtgtaggcaggcaagagaacatctagggtacatggagggatgaggactctacatcagtgccaacattccactactactcatgcaaacaacctttcttgctgtttatgactggtggtcaatctgatagctccaggatccatcctgattgcctggcagccatgccattatatttacaaaatatattaaatattctctcttttaaacatcagaatcctaggttcccagcaggactgaaaaagttgataaggaacccaattagagaactgcaaatgcaaagactagatttcaggttgtgatatggtttggctgtgtccccacccaaatctcatcttgaattttagctcccataatccccacatgtcacgggagggacgtggtgggaggtaattgaattatgggggtgggtgtttcccatgctgttcttgtgatagtgagtaagtctcacgagatctgatggttttataatgggcagttcccctgcacacgctctcttgcctgccaccatgtaagacgtgcctttgcttctcctttgccttccaccatgattgtgaggcctccccagccatgtggaattgtgagttcattaaacctctttttctgtataaattacccagcctcaagtatgtatttaatagcagcatgagaacagagtaatactggtggtcagaagctaagatcaaggaggtggacttcaggtcaggtaaatgccaaccatgtagttgagtcagtgacttagaaatctgagcactgccatgtgaactattccttaaaagactctgtcagccagaggttcactatgggttacaatgatcactgagccccattcccaggacttccctcctcctcaactcccatctccctagctctcttctccttacaccagagccatgtaatttgggccagcagtctcatcttggctgcagtcatcaggacctgattccagtcaaaggaaatatatgaacctccgggtcagagctcagggggcttagctttaggctagcacttgattctcatgtctgttgaaaatacaccaaatggcatagtcattatttctttaggggtgtgtctttcctgctagcctgaggctttcctagaagcagtagaataaaagatggaagagaaaaagaaataaaggaatggaaagcgaagaaactgagctggctcctgcttttcctctctttctagaaaccagttttggacactggacctccatcctatttttttttttttttgaatacctgtcttgatagtctgcccagtgagccatgttcttttatccttgatatttttcttttaggacatagaactctaactctaaatttttgccccttttctggggccattagcctttagcacatgcttgattctcactgcaaagtcctggatcccaactctgagctaacatttacctgccctgcccaagggggtctgtatgaaccttcccaacctgatatcataaagctttttcctctctgaaagtctcttttcataaagtttatattcctgccaaggtcttgaccgagaggtctgtggattctaagaaggaaatgctgtagtcaggtggggaggtcatgagaaagatggggtcacagaaatggtggtagcttaataacaggaaaggcagatggaaccatgcctccttcataagggagaacctcacacaaa

SEQ ID NO: 81 - DNA, 51900 bp, Homo sapiens
ttcgaagttgatgttgcatcctacgaacataaagaacttaaacattctaacatgtctactaaatttttctaaatggagagcatatatttgctcagtttgggtattaggattatggaataagttaaaaaactatccttttttgtttctttctctggatcagtttatataagatagatgttatccattacttgataatttgataagtcttgcctataaaatcccctgggctcgatggcttcttttcagttgtagatatttagctcttatcatttatttccttattatctgcctatttagattttctatatcctcatgactcaaacttcgtaatttatattttctaacattataatgtattttatcaagactttcacatgtattggtgtaaagttctatgcagtgttctcattaaatttcttttatcttttatgtttctatagttaaggcactagctcattcgtaatgtgttcgtgttctttctttgctctctcctttgaataggctttttgtattttgtattttattggtgagctcccttttttcttttctatttaatttatttcagcttttatttaattccttcctgctgttttatctgactttgttttataattctttttatggctgcttaagtcaaatgcctcatttgtttattttcaatctttcttgcttcttaataaatgtcttgaagcttctgactgtggctttgcccacaccccataagtctgacgtgcagccctcatgctcctgctcatttctaatgaggtgaaaatttgagtttgattttttccatatccaagtgtcacttagaagatatttaaaaatataattccaaaatagataatttgtttgttcctctttttctaatattactgcatttttagactaacagtgtagtttgtataatttctatgttggtaaatttttgagattctaaggtagtcacaagttgagattttagagctaactaaacttgagttcaaatacaggttgtgccatctaccagttacatgaccttgatcaagtctgctaatttccgcaggctttggtgtcataatctattaaggaaaatgacaatccttatcatggggatgtgaaaattagagataacttatacaaaagatgaaactgtatctctcatatagtattcaagtaatgcatcagctattatgcttattattgttattgttgttgttacttagtccattaacccatttacatatcccaggaagtataaatttatttctattggttctcatatcctagttgctggcctctatctagatccagatttctgaaagttgacatagttgccattctttgattccttttttgtttttctgctgcttcacagtgtatgtttgagaacttcttatgttgcattcattggaaataaggtatacatataatttgtatatatttttacatgtggaattatcatatagaagttaaatatatgcattatttgtgtgtgtgtctctgagtgtgtgtgtgtacatacacacgtatttgcaaagctcagtcccacattcaggatcccaaagtttagtggaatgcttttgtatatatgacctggtttgctccttataacctgtaataggtagaataatggcctcctcaaaatgcccacatcctaatcccgaacacctgaggttatctgacatggcaaaggagactttgaagatgggattaagtaaagaattttgagctggaaagattatcctggattacttgggtgatctcaatgtcatcacatgtttcccataagagggagataagcgtgttagtcagaggaggaaatgcaacttagaagcagaggagaataagaggggagcagagtaacggaccatgagtcaatgaatgcagatgctccctagcagttggaaaaggcaaggaaatagatcttcccctaaggcctccagaaggaatgcagccctgccactgtcttgattttaagaatattgaccttgagaactgtaaaataaagtgtgttattttaggacactaagtttgtggtgattcattacagaagcaataggaaatgtgagacactcacagggaggtattgtctccactttcagatgagaaaattgaggtttacagaagttgagtgacttgcccatggaggtatgtctagtcaatagtggtgctgggaatcaaaacttaggagctcaagacgtgtgtgtgaatgtgagtgtgtgtgtacgactttaagcatatcacaactgtggatttacagtgatttttcttttccctgtgggtgggaaaagattgtggcttgcaggagagattcagggggaaaaaaattcccatccttgtaaaggaaaatgatcccctgagttttgaaacaggagcagttctcccccgccgagccacctaagggcataggaaggtttatgctaaggtctatttagttgttgggttttttttaaattttatttttgtactatgacacataattatatagcttctttagaacattctgtcatctgggagattttcctacagaaattctaaagagtgtaggctcacaggaaaccagccaagatctacatgaaactctatttatacatgtgccaaaatgaaaaatataaaataagtgcagagatacataccgggcattttagctgaaggcaatggatgtgttacccttaacacacccatcacattatagagaataccaaaactagatgggattttagagagtgcaccataaaaccttctatgtgtttagctcagagcatgttttatttaatcctcatagcaacattgtgagatgggtactttcattccaacattgtcacagaggatcctgaggcttgggacatctaagctcactaatcaaggtcacatgagcattttggaaaagccagaaccttgacttgggtcttcttactccaaatcctgtgctccttccagttaattacaaatgacctcttcctatctgtttgttgtttgaaggagaaaattgagactgacagacaaatggtattgtgtacaaactctcaaagcaaagtatttctttttctcatgtattttttccttatttattaatttattcttcaatggtttgtggaatcaacagaattatcaaaatacatatcctagaaactttttgaaaataaggaaggaatcaaatccttaaaaatattaagaataggccaagtgcgatggctcatgcctataatcccagcactttggggggctgagactggcggatcacctgaggtcaggagttcaagaccagcctggtcaacatggcgaaaccccatctctactaaaaatacaataaattagctgggtgtggtggtgagcgcctgtaatcccagctacctgcaaggctgaggcaggagaattgtttgaacccgggaggaggtggttgcggtgaactgagattgtgccattgcgctccagcctgggtgacagagcaagactctgtctcaagaaaaaaaaaaaaaaaagagagagagagaaaagtagttaagggtaagaatagctcaaggagctgcacaacaggtagacttggaccaacgttaggaataaatctaagtatcctattactaaggcaagaaaggaacaggttccttcccagctttcctagtgcagaaacctgtgaaaaccccaccctgggatcatcagggctagaaccagcacctaaggaactcaactgcattaacccttctaactgatatcatgggaatctttttcaccaacaccctcaggattgtcccaacattaaccaaacgaagatcagaggaggtgttctctgagcggtcttgggttgcaggttttattcaagggaaaatttagagtttctagaaaaagaaaagaaagaagtgaatagaaaatggaattccatgggaaactctggattaattatatagcagattttatctagtctaagacccctaataatggtaagaaacactctcagtttacataacactaagaaagaaacaaggaaaaaaaaaagactgccaaataaactctgtcaaatcattaaaactaagataccttcccacttcagaaatgttaaaatgtggaaaatatgggcactttagaatcaatgaaatatgtttctccactgcatgatttgggagagccttgactatccccaggcacactgggaacctgtaagaggcagttaggagtgcagatttttccacatgggaaactctgaacatttagtttgttgttgttgtttaatatttgaatgtctcatggaactaatgttccatacaatccacactggaaaatagctatccaaacaaatggatggatattacgtgtttccatcaattgtcggtgagcattttttacacctgagcttttacaaatgtttaaaaagaagagaaaacaaggttataatgtttgacaagaacctggcatgaaagtattctatgttaacgattagaagtaaaattcacgttctccaaccagaaatgaaaggggtaagggctcaggctttaacctaaaaggtggaaaccacaataaaacaagtgcctgaatgaattcccccatctcccaccaactcttccacttgttactgataatcaaaatgaaggccattgtctctgttctgtcgttcagtgttttctactgttagactagacttcagctttgacaatgaaaatacgtggcttccagttactatgcatattaaacatgtttatctcctttccctcttaaaattacataaagagaatattagacagagaggctattaaggactatttgaggctggatgtgttatttgagctaatgtgtttttagggcactttcatttaaattggaagcaagaaggttgggatatctcaagcttctatcccaattttacctcctaactggccgtgagtgcccccaccttgagggcctcagtttcctcctctaaatgatctgaaaaatactgaaacttaaaaaatgttaatgaggccgggcgcggtggctcacacctgtaatcccagcactttgggaggctgaggcgggtggatcacgaggtcaggagatcgagaccatcctggcaaacacggtgaaaccccatctctactaaaaatataaaaaattagtcgggcgcggtggtgggcacctgtagtcccaactacttggcaggctgaggcaggagaatggcctgaacctgggaggcggagcttgtagtgagtggagatcgccccactgcactccagcctgggcaacagagcgagactccgtctcaaaaaaaaaaaaaaaaaaaaaaaagttgatgaaatggctcactatctcttacataggaatatatgagaaataactctcttagcaaataacggcagaaaaaggtgtataactcctgaaaacaaaacaaaacaaaaaaactacaactttccttttctcatacaaggacaactatataatccactatgggtattttttctctttctctgtttactttggttgccaagaagcacacagccaaatttatctcatgttgagtgactctttcattttgagcttctgaaaccattttctctcccctccttaaaatggctctgatgattcctatctttatatgaatagccttttaaaaatatattgtctttatgtgagtaaaataagttctcttggaagtgtgcatggtagactctgtaaacacatacacacacacaaaacagacaaactttgttgctaggtaacttgccaaggtcttcacaggaggtgatgccctctcacctataagactggttctaaggatttattctacaggctttagcttagtgtccaatgaccttctcaatctatcttgaattcacctgcttctgtctaccattctggtacttgtgctctgtcaatatcaatcaggacccagtgaggcttaggcacctctttgcccctgctggagaagaactctactcaatgattatttgcacctaataaaagaccaggcacagagtagtcacaacaaatcttaggcggatgaattctttaattcaatcattatggttctaaataagtctttgggccaagcagtgggaatggcaatgaagacatgcagatgcctaggatgtagtccctgctcatgaggagttcacagtatgacagaaacagacaggaatgcaggtaaatcaaccaagctatgaggctatcacagggagagccatggggcctgtgcagccccagagaaaggatgatttactctgttttggagaacgtaaactgatgagagggcagccagccagaggtccagtctccaagagatgtcaagatttcactgggataaataagaatttgagacaaaatgtaaatattcctttcccttgtaggtagaaatgaaaataaataaataaataaataaatagacgagggaaaatgtcatttctatataggccctaaccccatgcaacattcagccaatatttaaatagtatccatttgaaaggatgaatattggccaggcacggtagctcacgcctgtaatcccagcactttgggaggatgaggtgggcagatcatgaggtcaggagatcgagaccattctagctaacacgctgaaaccccatctctactaaaaatacaaaaaattagctgggtgtggtggcacgcacctatagtcccgggtactagggaggctgaggcaggataatcgcttgaacccaggaggcggaggttgcagtgagctgagatctcaccgctacactccagcctgggtgacagagcgagactccatctcaaaaaaaaaaaaagaagaaagaaagaatgggtattaattatcttgttccaaggtaactgcataactcacacctgatgcctcttagggctcagagaaggcttgctgaaaaagtgatgcctgaattgaaacttggaggcgaaagctaaagggccagggacaaatgggagtcagtgggggtacaaaggagaaagagacaggagacagagggaacagtgttgtgaaaactccagaaactgaaaccaggaggcttaacttaggaagaggaacctagctggaaatgaaactggaaaagtcagactggaaacttctttagccatgttaatggaggaactttgcttaacaactattaattgaaaacctactatgtgccagtcactgttttagctcctggagacaaagtagtaaacaagagataaaatccagtaattacataattaaatgagatggttttatacttattagactaattataattatggtttactgagtgcttaactatgacagctcctgtgcatgtataatttcatttaatcttcacaatggtgctacaatcacttctaattctacatgaaagagcataggctcagagaaattgagtggcttgccaaagatcacatgactagatgtggccagaggtcagcaatgacatcagatctgtcttgactgagcctggaaccacaatacctaagtttcaatctcaacaacctcacttaccagatatgtgaccttggacagttactgagccactctgtgctttttttaaaaaaaaaaaacataaaatgggaatcataatagtaacatcgcttgtagaattgttatgagaattgaatgagctaatgtacccaaagcacttagaacagtcatggtacgtagaaagtcattagtaaatgttagctgctattattaacctggttgcaaacagatttattaaaccttctcctacccagaacactcttaggaaggtcatagagctttgagcaagttgggaaggtccccttgataatgagtttattttgttttccctgcttaattcaatagcatcccacttctctctggaccatctctctcacaagtatctgctaatagctttcattgtttacagtgcttctaacaagtgtggtaacttctcatttgcattcctaatagacagtttccaaatcctgttgaaactgcagttggttttaggatgcctgggttttgttttttgttttttttgtttttgtcctatttattaccatttggatgggttttaacagctcaccacacactctcacccattcaatcttctttaagacgctcacagtcctttcacaatatattaacagattagtcctgtctagtgcatcaggtcactagcaaatgttattagaatcacttaagttaatttatttaacaaacacatacagtgctaattctgtgcaggacattgttccaaagcatttcacaaatattaatgtaaatggtaatatatttagtccttataacatctctatagacagatattactattatccctgttttacagatgagaaaactgaggcacagagacataaattaacttgctgaaggttacacagcaaggagatgttgagccacatcactagtcatatgaccttgggcatgtttcttagccttcagagggtaacaaatatgaaatactttcctctcttcagaattatcattatattaaggtaggtattaaaattttactggtgagaaaatggaaggtcaggggtcctgaaaggcttgccttatggctaagggagagtggcagagctaggattacaattcgtgtcttttgaatccacggttccctgtaatgtgctgtggatggaaggtggtaatagtttctgatgtcaaaatccattattgctgctcctgctgctgttactgttattatttaccacagaagaacagcccccaccccaccccaaacacacagagagaaaaataacaatgacaagaacatggctgattctggatgcagcctgcagatctaaagccatgcataatttactcaacactgccctgcagtcacttaagctgaggagagatcgctataaattcaggtctgcataccctaatttatttcttatttattttgctgatacatatctagggcctccagtgagctgcttctacacctgcacaaaggcacctgcagccctaagtgcaactagggcaggaaaggagaccttgaaataagccctggaagaaaaactggactctacacactagaatcatacaagtttaattcatttttctggtaaactggaattaaacccatgcccacactcaccccctatttgtgaaacacaggactgaaaatgttgttacatgtcctgttctgcttttctatcttagtaaagacagcattaaatgtacttcttccatgagtacaagattatttttctgagtcacagaatgtcaaaagataagcaaatattctaatactaagacataatcagaaagggaatgaagagaagaaaaaagtctgttcttgtaagtgattactaaggaccaaatgctatatgcaaggtgctgtcaaaggcagaagtaatggccattgcagtctttaaatggaaagcaatgtaagttggaagaaatgtcagccatccttccccaaagatctcttttcacagatggtcaaactgtggcccagggagagaacatgacttgtcagaagtcactcagcaagttggtcccaacgtgttccccttttagcctcatacttatttcaaaagtcagtttgagtccttcaagagccagagctgtcctacaagcttcacctgtgttgtttcctttagccctcccctcctccagttaattgtccttacagatacggacattaggacacagaaaggctgaacagtgccctcacattgctacattcctgctgaaaccaagcttgaaggctggacttagcctgtgcttttatgcaccatacctgaagcctttgtgaaccttcaagacgtctgcttttgtctccaaactgcactgactaggcccatacaggtagattcagaagggcaggaggcttcagcaggaaaaagctcctggctctaggatgaggcctgggcatgggttatatttattacatttattaacccaatctttatttttctcatttttttcttttttaacccacccaacagaaggttatacttttggcttttggctcttggactaaaacaggaaaggcagaaaggccattttattgaaggtcaaggttcagccttgctgagctgtagtgtctgatcattttcccatgcatccctcacttctgtaaatggggcacctgggccttggggacagagactcacccgcagaacatgaagatggtgctcgaagtggcatcgtagggcaggggcagcgtctgctgcaggcacagctgctcacagccgccattaaagccatcagagcagtcaatgcctttggagtggtcgtagcagccagagccatccttcatgggtttcagctcctcagggcactgctcagagagagggcaacagggtagttatggcttgggaggttgtaggccccatcacaccctctcctccctcctggaagagacatgtgtcagggcctgacagaaaggtattcagtctccttttgtcagttaataactttgtgacaagttccacaagtccctttacttctctgaacctcagtgtgcccacctgtaaaatgggacttttgtgactatctgcttatagtgttgtgagaatgaagggtgataatgtcagcaaagtgttgagaacactggctcacacggcaacagcacagcaaatgtcagctgctgctaatattgatattgctgggatcatattcattattgtttctactgttattgccctatagggtctactgctagaagggtcacatagggaggctgccagatatatatttaaaagcctctaccagtatgagtgtaatttccagcttttcctcttctcactgtgtgacccgagaagttacttgccgtctctgagcctcaatgttctcatctaataaatgggcacaatacctgcaactacagatttgttgtgaagcttaagttggatcatgggggtgcataccttacttcggaatttggcacataatttggtactcataaaatgtgaattaccttccttcctgtcttgaattagtctcttcttctccaccattatccctggagccctaagtaagattcctgcatactcacatcaccatgaaaagggctcctagccagtctgctggactccagtcaggccttctcaaaaccatcctccaaatggccaacagagtgctatttctaaatagcatcactccccagcttaaataagtaaatgaatcttaaaacatgtgaagctgctataaactgataatcaaggtcctccctttatagacaacctagtcctctgcttggccatatgcacagccctccccatagccctctggtccctaagtaaactccaaggagttcaaccttcaatggcctcagctagaacgctcttgtcagtgggtctggcacctgctatgtgctccttcagtggaaaatcatatactgtggagacagatggctattgattaaatttagttttccatcatttgatgaggctgagctcatcttctccatcccagctgatggagaagtagttccaatactcctgctttcagaagagaaaatgaggtactgggtttttatttcagtcctcccgctggcatttcttgtccacaaagattaacacccagagcccagccttcctcatccatcaccggacatcactgattaaaatgccttcccaccatgagaccccaccggccaactccccgctccccttcccatgccatcgtcctaaacaacatcaataataaaacatactcacaaaaattaatttacaaaaaccacaataacaaaaaaaaaaaggtcagccctcttggaaattaaattttgcctgagaagaatttgtaattacaaatgcatgagagagttcttcaagacatttgagactggcgccaggaagagtgacggagaaagtaggttataaatggcctttgtcaagctgcagaaaggttataaaactgctgcattttgtgcttaaaaaatcaattttccatgtgagtgaagtgctgtacatattaatacaagctcagaggaagcccctgcttgtctctgaacattcactgtcagacaagagggcacctggtcacagggtcatttggagccgtttgtgagtactggggcctggcttcagtctgtttgcagactcgcggagcatgttgaaaagaatgactgattttctgaccaggtaacaggagacacctgggcagggtatggtctcagtccttcccatcccccaatgattctctaccacacttgtttttttaaacgtgttcactaagctccaggttttatctaagcgctttacccgttttaacttatttaatccctatagcaaatatatgaggtagagtggtaggctgataatggatcccaaagacatgtctctgtcctaagccctggaacttggaatctgtgaatgtgactttctatggtaaaggttatgcagatgtgattgtgtcaaaactcttgaggacaccctcctgggttttccagattggcgtaaatgccatcacaaatgttctcatgacagagaggcagaaagaaattacacacacagaggagaaggcgatgtgggggtggaacagagattggtgtgatgtggccacaaaccgatcgatgctgaggccaccacaacctgaaagaggtcaggcacagattctcctctagagcctccagaaggagcaccaccagaaatcaaatgccagcaccttgattttggatttctggcctccagcactaggagagaataaatttcttaataattatcttaagccactgagtgtgcagcaatttcttgcagcagacaaggtaggtaccgtcaggattcccactttgcagaggaggaagcggaggagagggtcacacagtttggtggtgacagaggcagagcttctcaggcttcccaactttgttgctattagctgcctaatgggcaagccacttcaccaccctgtcatttactgactgactgatctctagttttaagaagtcctgtcatttactgactgactgacatctagttgtaggaagtcctgttatttactggctgactgacatctagttttaggaagttagaataaggcagggcttagagctgatctaacctccttactttagaagtgacgcccagaaagttaaaggacatcaccccatattcctcagcacatgagcgaagaacgtgaagccaggcttcccttgccccagcttggtgttctctgtccactacactcacttcccttcaggttaaagcattttgcaaacttacatatcctatagtctctctccccaagatgatttgctgatgggaaactgaggatcagaaaggtgagggtacttgaccaacatcacacagcaaattaaaggcaagatttgatccacgcctgtgggaaaggcttcctaagtacatgaagtgggtttaccagttaccatcattccttcctctatcatggacttcaggtactgtgcctttgaggatgagtaggggcagatgagatctagccatcgtttgaaattacttgtatattattagtatttcaattagtttgttgcttactgtctgtctcctccaccaaaatgtaaatgttataatagtatggaccatgtggcttgtcctaagccatctggcacacagttggtacttgttatttgctgaacgaattggtggagtgctagaaatgacatttagtgtatctgtgtattaactttggatctgaatccacactacttcttataagttgtataaccttcaggcagtgacataaagtctcctatcttcacgtgattactgtgatgggtaaatagtacggtagccagcttcaaagatggtccccagtgattcctgccttctggtattaagactcatgtagtcccctcctacactgcaccagaattggtctatgtgaccaatagtatgtggcagaagaggaggtatgtggcttctaaaggtagatcataagagagatctttctctccctctgtctgtctctctctctctcatcacttgctctagtgaaagcaagctgccatgttttcagcagccctatggagagtcttatgtggcaaggaagtaacacctctggccaacagccagtaaggctggggcctgccagcaaaacatgagtgagcctgcaaatacactatccagccccaatcaagcctgttcagatattggcaaccccaggtgacattttgactgagactttgtagaggtaggccagaaccacacatagaagctgcttttgaatttctgacccttaaaaattgtgtgggataataaatactttttgttttaagtgacttgatttttgagataatttgttacacagcaatagctaactaatatagtgaaataaatgtatgcagtacttagcacagtgatcaacaaatagttctgctgttataggtatttgtaaagagcttagaatctggtttgagagataaatatacacatctatcagagaacgttagttatagaacaaacataaaaaagtatggtaaaatttgtttgggaaaataaaaactctgcaaactaggcaatattgaaacagggaggttttagtcttttctcctcctctaggaagggaatcctgtaggaaggaagttcctacaggaagagaaaagagacatctaatgtactagaagaggaagactagaattcattaccaggcactgtcacttgcttgcctcgtgaccttggacaagtccttgaaactatttgggactgttttctttctataaatagaggagccagtttggagacaagaatatgaggactaaagtcaggcctgaattccaaggaaagatttgtgacactgagcatataggcaggatgcttcacctcagagacagcctcaggttcctcatctgtagaatgcaaataatgtctctcttggaggcacttctgaagactgtatgagaaaacacttctaaagtatctggctttagacctggtacataatagacacctaataaatgaagaataattgaatagggatatataaacaagtaataaattaaccaaaaccccaaaagaaaaactagcctagttgggaggaatcacgatgtctgactagatgcaggtagtatgtccctcctccatggagaggaaccagaataataagtagatacacacattccaaacagattgtctagaagagaatgctaggattcaacaggggagaaatgagaagcaccagaagtaagtaagcagagactttgaggcagcttttccagtcagaaaccaactgagagctggaaggggctcccagatgtggggaaacagtaagagagaaacccccagggttccaaaatggggttttacaccttggctgtgagagaaactctcaacctactggggcctttggcctgacatacgaagtgcctaaagtttgcataaaaccattgccacagaatgagaacccaaataaaatcccacaggcatctgaacctggagtagacacagctgggcactattttgagagccaaaatactggggatctacagatatggctgctgctgccctgttctaaagagggagagggaagactgggtgctcccacacatccccaggaagctccttactgccctgctgcaggctgctattgagactgagacatggatagactgtacttcccacagcttcttgctcacctttcttgcctgagatggactctgccttctctggtatcaggcccaaagcaccgtttttgacagtttaatgctgagctgcaccctaccattggcatgagtttgggttgatgtggctgcagctgccacccagtcaaggagggacagggagaccaggctatcctatgcatatctaggacaatacccactgccctgcaaggggctgctgtgagaccaagactcaagtgggccacactcaccacagcttcttgccaatgtggctcacctgagaaggaccccatcctttctggtcacagcccacagctggcaccatgctgagcatttaatgctggactatgtcccaggcttggggccgagtttgaggtaacatggctgcagccaccaccctgctgggagagggacagagtacaccacactctcctaagcacactcaggacaatacccaccaccctgctatgggtggctgcgagactggggactagcccgcccaacccatcacagctcccagcaagaccaacacgggttgcttgagtcccagtgggttgctctaccaccatcattactgccatcagccacactacactagcttcccaggggccccaaaatctacccatacatcaggcccactgctcccactactagcttctaagcaagccaactaatggcccaagaatcagccctcaaaaacctactaacactgaagccagtgtaagctacttcggggcctaaaaccaggcacactcaccccactgctgccactatcaggtgtgaagactggctcactttgtattcaaggtcccagcttaacttcaccacaatctcaactaacaactgtgtgataatgaaaacacagtatctcaacatgtgtattatacagcaaaatcagtgctaagaggaaagtttatagcattaaatgcctacatcaaaaaattatcacaaattaacaacctaatatcacacctgaaagaactagaaatatggctgggagtggtggctcatgcttgtaatcccagcactttgggaggctgaggtgggcggatcacctaaggtcgggagttcgagaccagcctgagcaacatggagaaaacccgtctctattaaaaatacaaaattagccgggtgcggtggtgcatgcctgtaatctcagctacttgggaggctgaggcaagagaatctcttgaacccaggaggcggaggttgcaatgagccaggattgcgccactgcactccagcctgggcaacaagagcaaaactccatcccccccaaaaaaaaaaaaaaaaaaaagaactagaaatacaagaacaaaccacacccaaagtaagcaggagaaaagaaataacaaagatcagagcagaaataaatgaaatagacccaaaaagcaatgcaaaggatcaatgaaatgaaaaaataattttttgaaatgctaaacaaaattagtaagccactagcaagaaaagagagaagactcaaataaatacaaccagaaatataaaaacagacactacaactgatgccacggaaatacaaaagatcatcagagactattatgaagactattatgttcacaaaccagagaacttagaaaaaaatgaatatattcctgactacacaaaacctatggagattgaaccaggaagaaacagaactcctgaaccgaacaataatgactactgagattgaatcaataataaaaaatatctctcaataacaacagaaaaagccaaggactggatgaattcacagctgacttctaccaaacatccaaagaaaactaacaccaattttcctgaaacaatcccaaaaaaatgaggaagaggaaattctttctaactcattctatcaggccagtatcaccctgataccaaaaccatacaaggaaataacaacaacgaaaaagaaaactatacactaatatccctgatgaatatagatgttagtattttgcttaacaaaatactagcaaaaggccgggcacagtggctcacgcctgtaagcccagcactttgggaggctgaggcaggcagatcactaggtcaggagtttgagaccagcctggccagcatggtgaaaccctgtctctactaaaaatacaaaaaaattagctgggcatggtggcacacgcctataatcccagctattcgggaggctgaggcaggagaattgcttgaacccgggaggtggaggttgcagtgagccaagatcatgccactgcatgcactctagcctgggcaacagagcgagactccgtctcaaaaaaaaaaaaaaaaatactagcaagtcgaatccaacagcacatcagaaagatagtacaccatgacatcatcaggtggaatttatccctgtgatgtaatgaggattcaactatgcaaatcaataaacgtgatacatcacataaacagaattcaggaaaaaagccatacaataatctccatagatacagaaaaaaaagcattcaataaaattcaacatcctttgatgataaaaaaaatcctcaacagagtaatcattgaaaatacacacctcaacatagtaaaggccatgacccacagccattatcttactggggaaaaaaaagcatttcctctaagaactagaacaagacaaagacatcccctttcaacactcttattcaacatagcactggaagttctcaccaaagaagtcaggacacagaaaaattaaaagttatccaagctggaaaagaagaagtcaaattatccctgtttgctgatagtattgtcttatatctaaaaatccctaaagactctatcaagtttcaagataaaaaataagatgcagaaatcagtagcatttctatacaccaatctagctgagaaccaaattaagaaagcaatccatttacaatagccacaaaaataaaatatctaggaatatatttaacaaggaggtgaaagatctctataaaaataataacaaaacactgatgaaataaattgtagatgacataaatacacagagaaacatcccatgctcatgaattggataatcaatatgtttaaaaggattatattgcccaaagcaatctgcagattcaatccaatccctatccaattaccaacatcatttttcaaagcattagaaaaaaaatcctaaaattcatctgtaactagaacagaccccaaataaccaaagcaatctcaagcaaaatgaacgaagctagaaaatcacattatctgacttcaaattatagtacaaggcatagtaaccacaaaaccatggtattggtataaaaataggcaactagatcaatggaatagaatggagaacccagaaataaagccacatacctacaaccaaatgatctttgacaaagtcaacaaaagtacacactggtaaaatgatactccagttgtattagtccgttatcacactactataaagaaatacctgagactgggtaatttataaataaaagaggtttaattggcttatggtttcagaggctgtacaggaggcatggctggggaggtgtcaggaaacttataatcatgaagaggaaagaggcacgtcttcacattgctgggagcaggagaaagagagcaaaatgagaagtgttacacactttcaaacaaccagatctcatgagaactcactattgcaagaacagcaaggggaaaatctgcccccatgatacaatcacctcctaccaagcccctcctccaatactggggattacaattcaacatgaaatttgggtgggaacacaaatccaaatcatatcactggtcaataaatggtactgaaaaattggatagccatacacagaagaatgaaactggactcatatttctcgccacatattttttaaaaacctcaaaatggattaagacctgaaactataaaaatcctaaaagaaaacctagaaaacaccattttggaccttggccttgggaaagaatttgtgactaagtcctcagatccaattaaactaaagagctacacagcaaaagaaactatcaacagagtaaacagacaacctacagaatgggagaaaatattcacagattgtgcactcgacaaaggtcaaatatccagagaccataaggaacttaaataatgcaacaagcaaaaacaaataaccccattaaaaattgggcaaaagacataaacagacacttcttaaaagaagacataagagtgacccacaaacatatgaaaaaatgttcaacattactattcagcagagagatgcaaatcaaaaccacagtgagataccatctcacaccagtcagaatggctactattaaaaagtcaaaaaacaacagatgctggtgaggctgtggagaaaaaggaacacttatggaatgtaaatgagcacaacctttaaggaagacagtatgaaggtttttttttaaagaactaaaaacagaactaccattcaatccagcaatcccactattgggtataaacccaaagagaaaaaatcattaattacattaggtcggtcacggtggctcaagcctgtaatcccagcactttgggaggtctaggcaggtggatcactagaggccaggagtttgagaccagcctggccaacatggtgaaaccctgtctctactaaaagtacaaaaattagccaggcatggtggcaaatgcctatactcccagctactcaggaggttgaggtgggagaatcacttgaacccaggaggcggaggtcacagtgagccaagatcgcgccactgcactccagcctgggcaacagagtgagaccctatgtcaaaaaaaaaaaaaagaagaagaagaaaaaaagaaagataccagccctcatatgtttactgcaacaataataacatacgagtgctatttcataatagcaaaaatacggaattaacctgaatgtctatcaagagttgattgaataaagaaaatgtggtatacactcctacccctcccttctccccacccacccacagacacaccatggaatactactagggcataaaaaagaatgaaatcatgtcttttgcagcaacatggatagaactggaggcctttatcataagttaaataactcagaaacggaaagtcaaatatgacatgttctcacttgtaagtgggagctaaacaatcggtacacctgcacgtacagagtgcaatgacaaacactggagactacaaaaggtgggagaatggaagggtgggaagagtatgagggttgacaaagtactactgattgggtacaacgttcactattcaggtgatgggtataataaaagctcaaacttcactactacacaatgtatgcatgaaagagacctgcttataccccctaaatatataaaaataaaaatataaataaaggtaactgaaactattagctgattttttcttttccatatgtctaagtccttctttagaacatttaacaaatattcaccaaacacctacctactcagtgctaagcaaatgttttaggagctgaaaatgtagtagtaaacaagacagacaagacctttctctcatagaatttacattctagagaagagacaaataattaacaagtaaacaaacaaaatgattattttgtagagtaaaaaaatgaataaagataaaagtataatatgataaaaagttaacgaggatggggtgaaagcagcataaatttagcttaaaaatagggtagacagacttcttccactttagccttctttttcaaaagaagttttggccattatagttcctttgccgttcgtttaaattccagaaaaatcttgtctatacttataaaaatcatgccgaggttttgataggaattatattaaacctttatatcaattcgaggcatgtggacatctttattatcttgtgctatccaattcgtgaatacgtatatctttccttgtgattagatcttctttgatttctttcacgagtattttaaagttttactaaagctaaacgtggcccatgcatattttgtcagatttgcatctgagtatttcattactttttagggattgcaaatgatactgtattttttatatattttgtcagattcacatctgaatatttcattatttttcagaaattgcaaatgggattgtattttttatttcaaatgttcacatgttcattgctagtatataggaatacaattgatgttgtatatttttcttgtattctgagaccttgccaaacttactaattgcttctagaaatttattttgtagattccctgagattttctatgtaaaaaaatcatgtgatctgccaatgggtaagtcttatagtcttatttcttcctttcttatctgaatgccttcttccttttttgattttttttttccctgttattgcactggctaggacttcccacacgatgttgaataacagtgggcagagtgaatctgcttttcttgtctctgaccttttggagaaagtattcagtctttcaccataaatatgtcagctgtagctcttttattgatgttcttcgtcaagttgagtaagttctcttctattcttattttttttttgaaagttttaaaaatcattttcggtatggaattttgtcaaatgtttttcttgtatccattgatatgatgatgtgatttttcttcttctgcctgttattataatatactgatagattttcaaatagggaaccattcttgcatcactgtaataaaccccacttagttatgtgtatagttatcttttatgtattgttgaatcctatttgttaatattttgttaaggatttttacaactgtggtatatgcatgagggctattggtcttactttgtagttttctgtttttgaactatctttgtctgcttttagtatcaagataatgctaatgtcttaaaatgatttgggaagtattctctcttctttaattttctggaagattttttttgttttgttttatttatttatttatttattttttgggaattgacgtttattcttctttaaacatttggtatatttctccagtgaaactatccaggacagggatttggagctgaggggaggaggagtctaaagtgacaaaataaatttccttaatagttatagggctttcaaaattatctatttcatattggcgaattgtggtagtttgtgtttttaagaaattggtccatttcatctaattcatcaagtttatgtgtgtaaaattatttgtagcattcccttattatccttttgatttacacaaggtctgtggtgatatcacctgtttcagatagtggtaatttattttttctctcctctcttccttttcagtcttgcttgtgtttgtttagttttattgtcattttcaaataatcaattttttgtttcattaacttcgttgtttttctgttttctaccacattgatttccttccttcggcttcctttggatttattttgctctttttttttttttctaggttcttgaggtgggagcctagattattgatttgtaacttcctcttttctaatgtatgcatttagggctatacacatccttctcattgaatataaagacacagatatgttaaaagaaaaggatgaatcatgacttcagctgtgtcccccacacaacttgatacattgtatttttatttcatctagttcagtccattttttaatttcccttgagacttcttctttgacccattgattattcagaaatatgttgtttactttctaagtatttgaagatttttctgttatatctattatgggctgaagatttatgtccccacaaagatttgtatgttgaaatcctaacccacctgcaaagtgatgatattcgcagttgaagccttggggacgtgattaggtcacaagagttaagcccttataaatgtgattagtacctcacaagaagaggatgggagaccagagttccctccctctccaacacatgaggacacagaaagaaggcaagcaaggaaaagggaatttcaccaaaaaacgaattagccagcacctcaatcttagacttcagcctccagaactgttagaaataagtctgttgttcaaagcacccaatttatgttattttgctacagcagtccacagctgctgaaggcagctgttattgctctgttattgctttcttgtttgattctatcgtggtcagagaacacactccatacaatttgaatcttaaaatttgctgaggctttttttatggtccaggatatagtcttgtcttgatatgtgtcctgtaggcacttgaaaataatatatgttctatttttgttgggcataatgttctataaatgttaactagatcttttttgttgatggtgttattgagtccttctatattgttgctaaactcctgtctagttcttctatcggttttggaaaggggtattgaagtatccaaccatcattgtagaattgtctattttttctttcagttctgttagattttacctcacacattttgcagttctgttgtttgatgcataaacatttaggatttctatgtcttcatggtaaatgatattttataattatttggtgtccctctgtggtaattatttggaaggcctactttatctgttattaatatagctactctcacttttgtttgatttgcatgtgtctttttccatccatttactttcaatctgtctatatcattataagcaatgtgaatttcttgcagacagtatataattaggtcatgcttttaaacccactccactaatttatgccttttaattttggtatttaaactatttgcgactgggcacagtggcttatgcccgtaatcccagcacattgggaggctgaggcaggatggtcacttaaggccaggagtttgagactggcctgggcaacatagtgagatcctatcttttcaaaaaattgtaaaaattatccaagtattgtggtaagtgcctgtagtcccagctacttgggatgttgaggtgggaaggtcgcttgagcctaagaagtcgaggctgcagtgagctgtggttgtgctactatactccagacgacagagcaaaatgctgtttcacaaaaaataagaaaaaatttctaaaacagaaattatttacatttaatgtgacctgaacatttctggcattacattatattattatgtttcaactccaggtcttaattatattaatgaagaccaattctgatttttttcttgcccaaattactatctgaggggtctggggagtcatgccctacaaatcataaattctcatcagatgggtttatttaatcctatacattgtgacttactttccaatctggctctggcataacatgagacaaggaagaaaaggcaaaatactttatcccaaaacacgtttcttgacatattttgaaatggccctgcaaagctgttctttgtagggaaaattttgcatctgtaaagaatgtctattaacatagctacatctttttctttcagaccctcccaatcctaaagagattaactaaaatctgaataggaaacatttgttgtctatagtctctaagggcagccactaaaagacgtcaaaggaactttggtctccacaatctttatcttaaccagaacatccctatatccctatagtctggaaccaacaacccgctgcccccaaaagcatttgtaaaatgtataaaacaaagctgctccctgaccaccttgggtacatgttttcaggaccttctgagggctgtgtcacaggccgtggtcactcatatttggctcagaataaatcttttcaaatattttacagagtttggctcttctcattgacatgtatttatttattttagagagaggttctctctccgtcacccaggttggagtacagtggcacaatcatagctcactatagcctcaaactcctgggcttaagcaatcctctagcctcagcctcctgaatagctgggattacaggtgtgagccactgcacccagatagaccttcaaaccttctattttctctggcttctactgacactcatccagcaggggaaggtagtggccttgttactgacaagggaatgaagaagtcccagttccccatgtggccttctctgataccccaaaggcccctcttttcagctggatgaggtaggaattcacctccccactaggacttcacggatctcttcctggatgggagtggtaggtatgtctagtcactgttccccccttaatctccactaacaccacactgagtggaaggtggccccatgaatgctggtccgtggtgaatgtcctggctttctactagttcttccctgacaacaacccagcaggaagggggaaggtgcttcaatgtcatggattaggggtggaaggccatgctcttcactgatgctgaataggccaggggatgggggtgctcactatctatcattgagattaaagtcctggctccccacgccattcaaccgttgctcccatggggaggggtgtgttcattttaatttttttcattttctgtggtgtttggctggagtagagcacttattgtctagcatttttctgtcttgctaggttgtccttttcccggtattttggctagggagagcagttttgttttgttttgttttgttttgttttgttttgttttccttcacatgtacctactggcatttctgagctgcaggctcctttagctccaagaataggacacatgaggcaaagagagaatccagggaactgaccaccatgtctttccttgggtcccaaaggcttcagctggtctgcaatgctccacctttcagtcttatgcttgttttatataggacatccagggtttttggttgtatttagccagaaaaatagagaaaatgtgtctactcctccaaagcctgtttttgcacagccctagagctaagaatggcttttacattttttttttaaaagaacatgagacaaaaaaagaccacatgtgacctggaaagcctaaaatatttactatataatccttcatacaaaaaagttgaagacccgtgacttcagccatgttaaggcacctggagtttattctaagtgcaactggaaggcataggagggttgttggcagaggaataaagtgattttgtttgctactttgaagagattactgaagttagtgaatccagttatctctaagcaatttcctagagtccacaaaaggagtctggggaagcaggctctgtgcatctgggcaggggcttgagaaagggagtgagtcagcctaataaggactctagcatgtggaggcgtgcctctttgctgaggttttatagtaagtaggtgagaaagcggggagtctaacccaggtcagtgcagctccagagactcatatccctcattctgctctatttcaggggaggactcataggaagactctgagcccaagtctctgagccttgagattttgaagacctagcggggagggagaggaagatgcctggaggattcccataggttcctcccacaggctagccctgctgggctcccccgagcttcttcctccatactgtgaacctgctctttgctgcttcctagctcgacttttcatcatcaccaagccatttgtttctgtttgtaattatgcattttaatgttcattaattatggaatgcaaattgctctgagtacaaaatttgtaatgagctgttttaccaccccacccccaggtctagaaggtgggccagctgttctgagcagaaggaaaaacaaccaacttacaaaacagaacaatttgtcctagggcctgagtgaatcatatggtaaataagcctgggggacttcctgctgatgctggaggtggggccctgccccacctgggtcctgggtgacatcagtgtggcaatttcattctttgctacaaacttgggcctgaaaggcaggtggggtaaaggaacagcactagtcttagaaccagccttttactggctatgacaccttgagctagtcccttggcttgtctgagcctcagtttgtccttctggaaggtaaggattatgatgaaattatcctcaaagtaggggtggcaggcaaacactagcaggccctggataaatgcatgtgaatggctctccagattgctggattccagttctgcctggctgtgtttttttttgttttgttttgttttttgagacagagtcacgctctgtcacccaggctggagtgcagtggtgcaatctcggctcactacaagctctgcctcccaggttcacgcgattctcctgcccaagcctcctgagtagctgggattacaggcatgcaccaacacgcctggctaattctgtatttttagtagaggcgggggtttctccatgttggtcaggctggtctcgaattcctgacctcaggtgatccgcccgcctcagcactcccaaagtactgggattacagctgtgaggcaccgcacccagccaaaaatttccagttgctttcttttctttttgagatagagtttcactcttgttgcccagactggagtgcaatggcacgatctcgactcactgcaacctctgcctcctgggttcaagcaattctcctgtctcagcctcccaagtagctggaattacaggcgtgtgctaccatgcccagcaattttttttttttttttttcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggatgcctccaaacctgcttgactatgaacaatgacttgttctcctccaaggactaggtaagtatttgatttctttaagtctcatggccagagaaagcataataacagtatcacctcctactaatagtactcctctcaacaatagtatgcctcaaaaattatggtaaatattttttatttattgttattattttttacagacaaggtcttactctgtcacccaggctggagtgcaggcagtggtgcaatcatagctcactgcagtcttgaaatcctgggctcaagggatcctcttgcctcagcctctcgaatagctgggactacaggcatgtgccatcatgctcggctaattttatttttatttttattttttttaaaacaacagctttattgaagtataatctacatatcataaaatttactcatttaagtatatgattcagttattttaaatttgcagaattgtgcaaccagcaccgtgatccaatatttaagtttccatcatccccaaagatcgttcatgtactccttttgagacagagtctcgctctgtcacccaggatggagtgcagtggcacgatcttggctcactgcaacctctgcctcccaggtttaagcgattcttatgcgttggcctcccgagttgctggaattacagttgctggaattacagccccgtgtgtgccacaccggtctaatttttgtatatatatatttttttcctgagagggagtctcgctctgtcgcccaagctggactgcagtggcgtgatctcggcatactgcaacctccacctcctgggatcaagcaattctccttcctcagcctcctgagtagccgggaccacaggtgcccgccaccacacccagctgatttttttattttattttatttcattattattattattattattatttttttttttttaattgatcattcttgggtgtttctcgcagagggggatttggcagggtcacaggacaatagtggagggaaggtcagcagataaacaagtgaacaaaggtctctggttttcctaggcagaggaccctgcagccttccacagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaacaatttttcttagtacagaacaaaatgaaaagtctcccatgtctacctctttctacacagacacggcaaccatccgatttctcaatcttttcctcacctttcccccctttctattccacaaagccgcgattgtcatcctggcctgttctcaatgagctgttgggtacacctcccagacggggtggtggccaggcagaggggctcctcacttcccagtaggcgcggccgggcagaggcgcccctcacctcccggacggggcggctggccggacggggggctgaccccccccacctccctcctggacggggcggctggccgggtggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcgtccgggcagagacgctcctcacatcccggacggggcggcagggcagaggtgctccccacatctcagacgatgggcggcagggcagagacgctcctcacttcccagatgtgatggtggccgggaagaggcgctcctcacttcctagatgggatggcggccgggtagagacgctcctcactttccagactgggcagccaggcagaggggctcctcacatcccagacgataggcggccaggcggagaagctcctcacttcccagacggggtggcggccgggcagaggctgcaatctcggcactttgggaggccaaggcaggctgctgggaggtggaggttgcacgagccaagatcacgccactgcactccagcctgggcaccattgagcactgaatgaacgagactccgtctgcaatcccggcacctcgggaggccgaggctgtcggatcactcgcggttaggagctggagaccagcccggccaacacagcgaatcccagtctccaccaagaaaatacgaaaaccagtcaggcgtggcggcgtgcacctgcaatcgcaggcactcggcaagctgaggcaggagaatcaggcagggaggttgcagtgagccgagatggcagcagtaccgtccagcttcggctcggcatgagagggagaccgtggaaagagagggagagggagagggagaggagactgactctaattttatttttattttttgtagatatggagtcttatgctgaccaggctggtcttgaactcctgacctccagtgatcctccatctcagcctcccaaagccctggaattacaggtatgagccaccatgcccagcagtagtaaagatgaaatgagaggtgaaaataacgagactaaacacataatgaaagccagaatacactgtcagtcacaaagaatagacacaactgtgaatgaagtctgactgagccacttcctcaatgtgtgccctggctgttctgagtctcagtttccacaatttatacattggagaaaataactccttcctcactaggcttgtgagaggatcccaggaggtcatttacctgatatgtgcctgatgcctgacaggtgctcactaaatgctaactgctattgtagttaccttgttactttctccaaataggacacattcagggagaaatgtaagggaaccatatacagggaaatggttaggcatttcttccatgcctacttttccaatgaggaaactaaaactcagaggtcaggtgagctgccttgggtcatacagcaagcaagagtctgactgagcccaccactgaaggccccctgactatggggccaaatgaggttctcttttccctgaaccacatggaggtggcttgtctgtggtgttacaagtggttcagactggctagtgtaacacagagattctgagaaccttgtgggaagggccctgtaatgagttatcggaggactttggtgctttagggacagagaggttgcttgtggcatagtcttggatgtacagattaggtacagcatcttgggaagaagagatagggaaagatgcaaggaaggaaatgaaatgcatatttattatgcacctaccataagctggatgtttcccaatatgctatcttttttaatccccacaaaactcagaggacctctaagatacaatatactcattttacaggcaaggttattgaagatcacacaggctgaagaagggctgctgaattcttcaatatgaaccatccctttgataagaaactgagtgggcctggttcttctcatcccaggagagctctggtgtgcttcctggcatataagtgagtgggaaaggctctgccagtccccagtcccccacccctcttgccactcagcctcaatctgtcaaccaggccagctagcccgtctattaatgctgacattgatttggatcaatcaagatcccataattactgggagttttaatcaactcatgccaattcagctgccgctcaatttgtgctggacttcggtgctcacaaggagggaagcggcgagggtggggtggggcggggggagggcatgcaaaaaggattacagggatcaatagtccttggtaatgaaggacagcagctgcaggcaccaccagggggcctgagacttcagagtggaggagacagagcctgcccccatcccccaggagagctccctggcagagaatgaaaaccacgcccctgcttcacctctgcctacacctggatctggaaaccacttaggcactaccaggcagcacctgttctctgcagggtccaaccctcagtatctctctccacattttgccctcagccaggcctggcctcctcttcctgaagaatcttatgtatccttcagagccagcaatcccattactgggtatacatccaaaagaaaataaatcgttctaccaaaaagacacacgcaaccgtgtgttcattgttgccctattcacaatagcaaagacatggactcaacctgtgcccatcaactggtggattggatttaaaaaaatgtggtgtgtatacacttgaaatactatgcagccataaaaaaatcatgtcctttgcagcaatatggatgcagctggaggccattatcctaagctaattaacacaggaagagaaaactaaataccgcatgttctcacttataagtgggagctaggacgggcgtggtggctcatgcctgtaatcccagtgctttgggaggccaaggtggatagatcacctcaggtcaggagtttgagatcagcctggccaacatggtgaaaccccatctctactaaaaatacaacaaattagccaggggtggtggcgggcacctgtaatctcaggtactcgggagggtgatgggggagaattgcttgaactcgggaggcagatgttgcagtgagccaagatcgtaccattgcattccagcctgggcaacatgagcaaaactctgtctcaaaaaaaaaaaaaaaaagtgggagctatatattgggtacttatggacattaaaatggcaataatagacactggggactaccagatgggggaaggaggcagggaggtgaaagggaagaaacaggtgcaaggattaaaaaactacttattgggcactacgcttagtacctgagtgatgggatcaattgtactgcaaacctcagaatcacacaatatatccaggtaacaaacctgcacatgtaccctctgaagctaaaataaatgttgaaattattttttaatcaaattttaaaaaactctgtaaattatttctcagcagtctctgtggttatgttcctgagttcaaaaagcagaagaatgctgaggagacaaaaaaataaaaataagattaatccagatactgtcatttcctagctgtgtgacttcaggcaagtcactgcacttttctggtcctgtttttcctgttctaaaatagactcaataataaataaccgcctcctgggattgctgggaacattgagtgctgtcacgaatgaaaaatccttgtgtggaagttccttcttccttttgatgtcccacatcagaaagaatcagttttctttttctcccatgttcattattcttctcctagcacaagctttattctgccaggtgggacggtttctgggtcacagtctgtttccctacgagtccacagctatttggggacagggactgtaatacacacagcttccttttctcagtccagcacgtgggagggagacaagccagtatgcaaggcaaatgtggcctttggggtcaagcaagcttgggcttgaatcccacctgtctttgccacttactaaccatgtaatgttagccagtcacttcgttaacatttgaacctcaacttcctcaaagtaaaatgagcctaattacacctactcagaattgctacggaggaaaaaaaaaaaaacaaaaagttagacatttaatgtccctaacatagtatctagcacaatggtaagatcctgattgttataaaagttgctattatgattattatcactcttaatattcagtgctcagtaaatatttttggaatgtaataaaatgtctggttgtattgcttagttttggcttgagttccaatgaaataccaacaggccattatccccacatgccagccatctgtgcagccttcaacacacacttactgaagacaccagaaaggaaattcaaatgctttcaggacacactgtgggccaggcactataggaagtgttttccttatactgctttgctgaaggcccacacttctatgagattgctgttattgctgttattagcttgatgtctgcagaagagaaaactgaggctttgtggctggatatgtctttccttgtagttctagcagaaccagggtgcaaacatgggggcgtttgactccaggcccctgctctctccactgtaccataccattctttcttttttttgagacggagtctcactgtgttgcccaggctggagtgtggtggtgcgatctcggctcaatgcaagctccacctcccgggttcacgccattctcccgcctcagcctcccgagtagctgggactacaggcgcctgccaccatgcctggctaattttgtttctcttatttttagtagagacggggtttcaccgtgttaaccaggatggtctcggtctcctgacctcgtgatccgcccgcctcggcctcccaaacgtaccattcctttcttgtggaggcaccaagaagtagaaaatgtgagagttcccgacttcaggaagaatctagaccaatggtagagatcaggtaaattcccagagggagaaaagtcatagttcaaaatggcttatgataaaaaatgtgccaaacaacaaaaaacaacctgattaaaacatgggcaaaagacttgaatagacatttctctaaaaatgatatacaaacagccaattggcacatgaaaagatgaccaaaatgattagtgaatcattagcgaaatgcaaatcgaaactacctcaccctcattaggatggctgttaccaaaaattcagaaaataatgagtgttggtgaagatgtggagaaattggagcccttgcacactcttgataggattgtaaaatggtgcagctgctatgaaaaacagtatggaggttcctcaagaaattaaaaatagaactaccatatgatctagcaattgcacttctggatatatatccaaaagccctgaaaataaaatcctaaagagatatttatacacccttattcatagcattgtcattcataatagcctaaaaggtaggaacaaccaatgttcattgacagatacatatacacacacaatggaatattattcagccttagaaaggaaggcaattctgacacacgctgcagcatggatgaaccctgaggacattatgctaagtgaaataagccagtcacaaaaagacaaatactatatgactctatttatatgaggtgcttatagcagtcaaattcacagagatggaaagcagaatggtggttgccaggggctgggggaagggagaatgaggaattatttaatgggtatagagtttcagttttgagagataagtgctgtagattgggtgtacaacaatgtgaatttgcatcacgctaccaaactgttcacttcaaatgcttaaggagataaattttatgttatgcatatcttatcacaattaaaacaattttaaaaatgtattttaataaaagggaagcagagagtgaaaggcataatggttcctaacttcaaagaaaatctagaccaactggagggaccggatcaaccccaagagagagataagccatgtttcaggatggtttctgatcaagagcagtgctgcaatgacagcatgctactgcgtggctgggtttgctcacacacactgatcacagctaattatctgaatatatgctggctacttttcccattagaggagtcccacgtaattaggggacacaggttaccatccttgctttgggcacatccctgcccttctctggccgtcaatcttcctaactgtccagtgagaaaagtggtagctggtccgtaaggggtctcccatcttggacattctatggttctctgccagtggtcaataggaattccaagggaggtaggttctcgcagtaggcagcacctgctctagtgcaagtggcttgggaacatgcttgaagctttcccctacagcctcttaaaatggctggtcaaccttttggtggcagtcgcgaagccttctgcacacagcaagggttcagttcaacaaatgcctattcagaacctgctgtcttccaggaattataaagccttagcttcattctcaaaaaaaaaaaaaaaaaaacaaaaaacaaaaaacaaaaaacaaaaaaaaacatatattctaatggggggagaaaagtaagtaagcacattcttatagttctcaaggttttgttttgttttgttttttgagatggagtcttgctctgtcaccagactggagtgcagtggcacaatctcggctcactgcaacctctgcctccctggttcaagtgattctcctgcctcagcctcccaagtagctgggactacaggcacacaccaccatgcccagctaatttttgtatttttagtagagacggcgtttcactatgttggccaggatggtctcaatctcttgaccttgtgatctacccgcctttgcctcccaaagtgctgggattacaggcatgagccaccgtgcccagctgaggatttttataagcaccaagggctgaggcaagggaggccagggaacactttcctaggaaaatctgccaagactcctgaggaatgtctattcaatacctatctggtgatgataataaatagcctttgtgtagctcattaataataataatagctaacacttaatggcacttatcatgtgccaggcactgtttcgatgtgttttgaatattaactcattatgtgcacagcctgatggtataggaactactagtctactcattttacagagagggaaactatggcacagacagctttaggaacttgtcccaaggaaacaaggcaagtgagtggcacagccaggatctgaagccacactacgctgccttttacaatgtgttaagctttctaagttacttcctcatctgttatatttttctagcctcatggagagaggtgctgacgccatttggaagaataatatcctgaggtgcagagatgtaagagaacttcccaagatcatacagtgattagatgtggggcgggacagaggctccactcaggtctgcactgctacaaagctgtaccctctgggctgatggcatggctcagtgaaggagctctctctgttcccaaggcagaggctctaactgtcttcacctgggttcaaggcgctgggaggaaaatgaacatctgttgtgtaccccccatacaccagacacactgctaggctatgctaatttatgaaatcttcccaacaacccagaaaagaatgcaccattattttcaccactcacagatggaaaacaggcttggagagggaagatgacttgcttcaggtcctcaccatagatgcttggatgtctttctgttttcagaagcctcatgtcctattacttctctgagtagcacagagccgagggaattttgctacagatcaagtgcagggaggtatttggggaaaatagcttattgtgacattgcctgagcacttgactatgaaaccaggtctcctcctaagagcattgaatgtgcattaactcattccctcctcaaagcaaacctatgtggcaaacaccaaacaccaatatcatgcccacttaacagatggagaatctgaagcgcagcacgaagaggtgtattaacttgatgaaggtcacacggccagtaagtggtggagccaggaagcctggcacctgagtctcttttcttagcccttccgcaatacttcctcatacaacaaccatgtaaggtagtgtgacataggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaagacacttatcactttaatgataacaagaattttagaagttatatgcccagaaacagggataaacaccaatatatattaatttgcaggtactattatttcaccctttttttgaatactgggagattaagacttaaagaggtttaaagcaacttgtctcattacagaggaagggatcgagacaggatttgaacctgtacagcttgataccaaataacttgtgcctagcagtgagttacttattcaggggtcagggccaggccttcattagggcaggctggacatacggacttttccatgctgctaggtttaacaggctggtatcgcttccccatctcttgtcactaaaaactcaattagcagcttgaggctgtgtcctcacatcacaccttctcattgatcactcagactgtgagtgagaaagattttaaagctggttggctttgcaaagcatagagcagcaaccattgagcatatgcttctgtgggtatatatttattcagcttatgttgagtataattttggatggtatgcatattttattttttgttgcagagagcaatttaaaagaagaaaaaaaatccttctctgaatggagacagatgccatatatgttggaccctcaggggattgaaaaggatgaggttcccaagtccagtgttctggggacggacgtgggtggaaggaaactcacaagtgatgggaatccaggatcaactgcaacacccacagcaaggccagcaaggcactaaccacccagtccagggcagggcccttcaaggttttattcccaaggcctccccagtagcctgtctgactgttctctacatgctatttactgagtactaaatattgagtgatgggtgaagtgcacatcatcccccttaactttccccacaactccatgttgagatgctgttgtacatatgagaacacagatactacattgcccaatgtcatcaactagaacagcaggaatctgtgtgctgggaagccagaccccagaaccagtgctctcaaatccccaccaatgtcatctagtggttactggagtccttattttggagtcctgatatccatgctaccaattcctatctgagtgacaatgaacatgtcacttccctttctgagttggcttccacactcacaggatggagactgagataccattttgctagggtgttatcaagattcagagatccaaagttacacttaaaagtcatttgagacatttgttctttttttctaccccaccccctgcctaaaaggttctcctcttacccaggatgaactcaagatgtaacattttaaaatgagccttaggaaaaaacctgcaagggttggtaccagctggagaaaaataaatacgctcatgtgggtgccaaagattcaaaagagagaagcagcagcccaaaccagagtctacaccagagggaatcattatggaaggagaaagttcatcctatcattgtgcagaaaggaaggatccatgtgtgactctagggagtaggatccaaagcatcattttctagctctgtaaatagactatggactctttgctagttaggacacagtatctttctaatgttagggcccagaagagggtcttacacagcagtacttagttgttgagctctgaatgcagctaaaattcaactgtgggttgtctaataaccagtttttgcttcaaccaaaggcaagtttgatctagtttgataagatgtgctagatgctggagaatccattaccaacagtcaagaatcacataaaagagctgctctatgcatacctaagtgggaaaactgtaaaaaaaacatgattagcataaaagacagggtcttggccacttccagaagggaggacagggttacaattggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgttttagttgaattgcttcattacctaaataaggcaacaacaaaaacgtgaaggtcagttccaccacttctgcctgaaattcctccaatggagaacctcatcttctccctaaggttcaatgtgcatgaaagaacagctctgcagagtaagttgaggggtgccaaatcccactggctcttatataggcctatctgcagtgtcttccccctctggaaccaagtacatctttgacttaggtactgtggcgggaaagggagatgccccagagagaatcaagtttaactctgaatttgtaggaaggacaggagcatagctgaggattcacagtaaacagagtcatgttgagaaacagggtcccttcatcacctcggactgtattatccccatgatcatgggcctgaaaaatcacctttccctttcagtgatgatgaagaaaatttctgaaaaccaaggaaagccagaaaaggctactaagtttcctagctcaacaagctcctctctacacaataggacctgatcttaggaagggaggccatggccctgggttttgctcatgcctggctactttcactgggtccggccaacaatattgtaaggtgcagggatcattcccattttatggatcagattagaggggctcagatacattcagcaatttgtccaaagtcacacagcttcccagttacagggatgggatttgaatccaactctgaattatggacaagtctattctttttactggactggaattctgattaactagcccatctctctctaggaacgtctgtcactcagttcgggtagaattttctcaatgaggagaaaggctattgagtgtttgatgaaaccttctcactgtttgctccctcaagggaaagggatttcaaaatacctgggctagtgggtcaagacttcttaaagcagggatcagagagaagctggagaatacaggcaaaaggatacctttattatttgtaaaatttaataacaataataataatgtcatttgtcatccatttatcctcaagacctatgataaaagacaaaagaatgatgataaaaataaaagcatgttatcctgggtggaagagagtcctacactggaatttcagacacctgggttctatccaagcatagctcttgtgctctttagcctcaatttgatcatctttatttattacccaaggggaaaatacacacacacacacacacacacacacacacacacacacacggttaagatcaagctaggaagtcagttgtcctaaaaagaaaaaaaaattggaaaagctctaggaaaagcagaatgtgtagttctgacttagaaaattgtcccgaagaaacacaactgtatgctttttatgcttccatttttaaaattacatatataaattcttatttatatttgcatatgcatagggaagaagtgtatggaaggatatgtatctatctatatatacaccaaaccgtggcacatttatctaaagtgggtgagtagttaagaaagggggccttgagtttttttctttatacatttcaacactgtacaaatttattttattttataatgagaatgagctacttttagaaaaccaaaaaaaatttttaaaggaagattgatgatcagatggagaaaataccttatgaatgcaaaaattctattattataattaagatgaacacaattattccagcttttcgtttcagagctaaggagaaggtgtctgatgatcagcattctgatgcctcaggagacactcactggtgcttggcacaaccactaaaagttctgtagtcatggcttctgacctcctcaaaccctcaaggagacagcagacccacggcctcatttactctcctctgcattgcctcttgtatctggaccctctctcacagacacagtgcacacctcactggactccactcccacatgtactacatttattttatcactctcctgatcagagaccctttaggccaaataccctagcccgcccttgggctgcactctgaaagaaaagcagcacctaaaacagtgtggagcaccagatgctctattgctccttttgaaaaaatccatcccacaccttcacccaaatcatgaaacactaatacaatttgaaaactgtccttacagacttctgggaatctcttctaaagaaacagctcaaaacacagaaggtggcttctgcccaaaggtgctcagagcagcacggtttataatagactaaatctggaagcaatcaacatgtccaaccagaagacaaagcaaatgctgggatgttccccttcatgaaatattaggcaatattagtgatatatatgaatttgtcctggttaagggttttgttatcaacctgctttggcccaatttggcccgaattccctgctctagaactgagtagctttgtggtcctgagcaaattacctaagttttctctggctcagttttcccatctgtaagaaaagggataataatgagatccacctcagaagccttgaatcatagcaagcattcaaacaattttagctctcatcattgccaccaccaccatactcaaccctgcatgagatatcagataataataatagcaaccatgttttgtgcctgcttagggccatgttctagcccattgcgtatgcattctcagttagtcctaacagcagctttggcaggcataagtagtattatccccattttactcaacaggaacccaaggctaagaggctttaagtaacttttcccaaagtcacatggctagtgaatgacaaggtaagattttggcccaggtttctctgatgctaaaaactgtgtacttaagcactatagtgtcttcccaaaagtaggggatggtagtgggagatggtagtgggagcagtgatttatgcagggcttgcagacaacagttgggaaaactaggagtgcagcttccatttcctgcctccaatttggggcttccttctctctttttttttttttttttttgagacaagtctccctctgtcccccaggctggagtgcagtggcaccatcttggctcactgcaagctccgcctcccgggttcacgccattctcctgcctcagcctcctgagtagctgggactataggagcctgccaccacgctctgctaatttttttgtatttttagtagagacagggtttcaccatgttggccaggatggtctcgaactcctgaccttgtgatccgcctacctcggcctcccaaagtgctaggattacaggtttgagccaccgcgcccggcctcccttctcattattccccccccaccattatttcaggaatcaaagggtaaaacccatcactttggaaaaaggggggctgcttcctgactttaacagataatgacttccacacaataaaaccagcttaccagaaataccatcagacccagcaaatccaagtcccaacgaaataaaataaggggaaaaatagagaaggcttcaaatgtcatgagaagaaaaaaatatttaatgtcataaaagggtgcataggctttatgagaatgccacacacaataatcttggaaaccctattaccccacctacccacccagcctgctccaaattcataaaggaaagatgcaaatgcactgattggaaagatgcaaatgctcctgattgaggagctactccctccttttcatttcccaaactttgagtcctgtgtgcaggcattgaatcagtggacacagtacagttccaattcccttctttactggctattcttatgtccttttccaatacagttccaatttccttctttactgactattcctatgtccttttccaatacttagcctctttagcttcctctggatctcttggatgcagtggaggagaaataaatactggacattgatagagggtaaagagaagaaagtgcccctctcttcatgcttcctgacattggggacattcgccttatccctagggaactattctcagccttgggagggtgtcttctgatgaattaagagaatgagctttggagtttgacagagtttggagtttcctctgcctttacctggctggttggatttgggcaagtttctcatactttctgactctatttcctcatggataaaatgggagtaataataatgctttccttataaggtagctgtgaggatttccagggccaggcacataattagtactgaaatgttctctctatatatccgtatcagtaatactaggcctgatattatttatagcatttattcatttattttttagtagctttaataatattaggcctagtattactgatcaaggtattcaatacatatagagaattctctgtctgtgaacctatttgactagaggatactttgatgaagacaccatgggggcgatatgtcatcctgtaaatcctgttttgcaacccaagagcctgaagttattcccataaagacacctgcctgctgcctttgcatctttctaataatttttaaaaagaaaaatagggcaaccatcagtcctctcattttggattttggcaaaatctgtctcagttgtcttctgaatctatcataccccatgtggctgatctacagggataaatttagctttgaaagtccatttctggaaaggaaaaacaagtctccaagggctagatcccatggaggctcagcccagctgcaccgtgtaggagggttacatgcccaggcaggcagggctgggctttccctggtcagcagtgcctgggctgtgctccaaggtgatttctcactctgctgactcttcttgctagtcttccccacccctcttgagttttgttcctttaattacactgcaattgagtcattaagagggggaaaggatgaggaatggagaaaagccggtctctctcccctactgaaccagattccagcttttgcctccctctgagcagtgctataaggttcctggcctatactaaatggaaatccatatgtttattcatcttgacttttagaaaggcagctcttgttgttgtctctcagcacctgtgcaatcagggatcctatgatctttcctaatatctggcaggccagatggttttttagatcaaaatgaaaaaagaaaaagatggggcagaggcggcagaaatgtgactgggtgatttgtagggttgaggagtgtgggattggtttgagattgttctagaattcagagccagggctaagaactgaccacagaggctcctcctgaaagacaccatcactctaagacccagcgagtatgcaaatccttccacttcccttagtcctttctatgaaggccttgactattcgatgttgcccctcctttctatcctttcccattatttttctccacatatcccagtttcctaccagatagtttcatttttctcatgtgtgaagtgaaggtaataataatatctggctcatattattactgtgagcataaggttggttaaaagaagcaaagcacttagaaccgtgcttggaacagtctttgtatggatagttgcttttatattactagcttttcttttttgtaaaatggacatgatagttccgggtaggtgataattataggcattaattgccatgaacataggcaaaataacacatagtaggtgcccagtgagtgccagttctctcgtatgaccactcttttctctgcaatattcacaccaatcctcttagagaattttcacacagagaaacaaagtggtttgttcaagattatgctgcaatcctgctgaagtctgtcttgtcttctgaaggggcttataaaacaaggcttaactcttgtggtgttttgctcctggtccattcacagtgctggatacaggaatgttgcgaaataaataattatactatatagtgacaaagctgatgctatggggccattaggtgttggaatgtgaaactggaagggagtcttggaattaaatctaggttgtattactacctccctacatgaacttgagcaatttccgtatctttctaggcctttgtttttctgtttgtataatgggagagggtcctttctggctctggtagcccttgtctgtctccatgcaatgggtaaatgggtagattaaagatgatcacacattctttgctactcttcgcattgacaggtgaaatctagctctttcccccttgaatctgggctgaccttattgacctgcttgaccaatagaatgtggtagaaatgatgttctgagacttctgaggctggggactaagaagccttgcagcttctgcctaggcacttagaacgctggatcttgggatggtcccttggtaagcccaggttccatgatgtgagaagcccaagccaaatggggagcccaagaaaaaatcctctatccagttgacagccccagctcaggtccagcatagccagtgtcaaccaccaatggtgccagtcctagccccagacaggtaataaaggaacccttctgcaaatgactccccagtcccagatgccccatctgtctttgatcagagacaaaccagctgcaccctccacatagtcctgattcacaaatctatagacaaaacaagagtgtgtgaagctactgagttttggggtagtttgttataaaacaatagaaagctggaaccaggaaagtgagctatgaactgatacttcaaaaagggttaaggaggacgcattgtgtttaccagattgtctggtgttgggttaatcaaaaggcttcctgtgctgggaaaaccagaaaaacataaaagaatggcattagtgaagtgcgtcagggggcagcagttacttagagatggtggtggaagtgtcctccatacgatgctgtgattaagtgcttacagttttctttgtttttattctctatcttgattaaaattttgcagtgtttatactgccacacagaataaatggacccatagcttacatttcaaactgtgccttgctgacatcattatgtttgtcagatttataacatttctaatatacaacaatttttcactcttggaacactgaaggggaacacaggctccctctcttttctgatgtttcattcactgttacttcctctatcactggtcaagggatatggtctccttggaaataactgaaaacaaaaataatagcataattatttatatattatttactgtatcaccctcctcatatgatcttttacctgttatcagtattttattgctattgtagcaaattactatgcaattggtggtttaaagtaacgcaaatttattatctcacagttctacaatttaaaagtctaacttgggtctcaatgggctaaaatttaggtgttggcagggttgcattcctttctggaggttccagaggtaagtctttctctttgcttttccagcttctaaacaccacttctcttccttagcatgtaactctcttcctccaacttcacagctggcaacgctgcctctctctaccccactcctctgctttcctgagcacactctgataattcaagatattctcgctcttttaaggtcagctaattagtcatcttaattccttacgcaaatttaaatcctggttctgtcatgaaaggtaacataccagtcacaggttctgggaattaggatgtggacatctttgcaggggccattattttgcctactacacatcttatggccatcctccaattggccaattacctatatgagaaacatattatccaaagggaaggttaccacagcagaaccagaaagctgagcaaaaatatgtcagattttttaaatcttgtgtttcaaaagttgaggtctagaaggtagagctattttagaaggtaaaataataatcatcattataatgacaataataaagcaatagaagcatctgtgatctgttagagaattaccttcccttgtatccacaaagaagtaaaggtcatctgagctggtggaagacaggaatgttggaagtcaaacaaagtaatctagaaaatgctaatgagtgttctaaaaggggtcccatcctctatccttaccaggctacgcccatgagtgtatgaaggggatgagggggtgcagaatatcaggtgggtttgagggctatgaaggcaaaggggttctgggcgtcacttgctatatagcacaggttgacagcaagcatggtgagtgatcctccccactgtgaaaacagccaactacagatcctttcctggcatgtctagatcaaaagagctctagacagctttcctcagatcctccaggtggaactgttggacatttctcaggccctctggaggctggaaaaactagctgacgcacagagccagctggccttaaatgaccttgtggtggaataaagtggatgaggcagcagctgtactacacacctgtgagtcaggtgggaatggagaggaaggagagtgatggacaagggccaagtgatgcagcaggtaccagattaaaaagtgatggcccagcatcaaacatgcccttagctcctaggccttacaggtacattggccctttgagctaaaatgttcagttaagaggtgggaggcagaaaaaaaactgaaattgactagagttaagtttccactaacaatggaacagaaatgaaatgaaattcagttacagaaacgtaatagaacattagatacgctgtgctcctaaatttgtgtggccccaaatatatccactacatacaaatatcagtaatgtggtctccttatctcactcataaatggtactttgtaaatcccaaatcattgccagttatattctttgagctctttcagttttttgtttttgtttttagaaaaatctgtaagtactgttgcttccttttgaaagattaagaaactgatgctaatgaagtcaacatagactccaaagctatggtcattctaatgcctaaatccaggctttagcccaattcactcagcccagcctcctttccatgattcttcaacgagaactcatctcagctcccagtgtgggaaagcaagccaaagtggccctggcagaaggactgatagtgagacatggtcttggtcctccaccctgccacctggtggtaagaccttggaaagtcactctgcttcctgagcctgtttccacattcctgagggaatctactgcccaggtttgttgtgaggatgagctcttagcttgtagacatgctttgagaatgctaaagtattctaaaaatataaggaattatcatgtaatacctgaaggaatgtcttagaaggtgagctatgagaagaagtttctctttacagacatgatggagagtctacagagaaatgaaagggatttaaaatctcagcataaacgtggtatttccctgtctattctgaagcacagagaggagcttgccttacatccattgaaccttgaagtagtggttttaaaattacatcctcaatctagagaggagggtctttgacaacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaagagaaggagcttaattaatttgagaaaagagaactaatggaaaagaggaaagaggcagacaacttaatcctttgaaaaaggtcagccttacattctggacacaacacagaacatccttttgagctgtttgtccactggctgggtttcagacttcagcaaatcctcctctccccaactagcacttttccaatgtgctatatgaagggttaggtttcaatggtctgaggcagacagctgttgatgtatatcaatctagcatctacaactcctgttgccagcaccccagtttttcttgagagtctatgccttcccccatctcagggccatgcatttcaggtgtagctgcctcctggtgcaagctccaagcatggctgtctctgggatgagcccagttaatccccctgaccagcaattggtgcagggataaatgggcatgagaaccaagttggcacaatgagaaggaatctggtgacagtagttggaggtactaggaaagaagtgtttttgtcctgtaggacttgcatccagcctgcagctggcccaagaatggcacagtgctaaggaaagcagagctaagataaggagggggattccaatgacattgcttgagtccttcaatccaattttctccagacttccacttaagccaatgcatttccttcttctttttttttttttttttgcctatactagtttgagtttagtttctatcacttgtaatcctgagaattctaatcactaaaatttctaattgcccattcacatctgaagagctattaatctttgagtctcagatatagtttcattgcattatttcattctagaagcttcttcgtattgatctcctgacctttgtctgtttctcagctggtgtgtagctgcactaagggccaagtgtgtgttctgtctcccttgggtcttgttcagagagcctagtccagagcaggattcctatccctggttctatccttcccttcttctttcttttttctttatttactgagatgggtacttctggggtgttgagccgaatcaacagattccctgggttctccctcagttttttaagaaacataaactgaaaaaccagtctgtgctataacgtgtcacaggtgacttaataaagctaagtacagcatacagtaaagatactgtatggaaaagagggtcacctgcggggaggga

SEQ ID NO: 82 - DNA, 12232 bp, Homo sapiens
ccactgatacaaaatttttttcattctaactcctttccagtctttctagcaaatacttcctcttctttcatctttcatatttgcctttctaggtagttttgaaatattttttctttcctgcttcccccttctccatactctactctgttttaaaaatcccttgtatttatgccacctgactgaggcatcctaatgtagttgaaaaagccagaggcccaagaggctggttgattttcgtttagaaatcatctttgctatttctctatggagtcaagtcactttatagttcctactaggtcttttcttttctcatttgtgaaatggggaaagtagtacccacttctcaggatcactgtgtgaattaaatgagatgatgtgtatgaaactgtctagcacatatgaggctctcttgaatgttgtaagtaaatccaatcatcttacggatctcacccactgttttccactccagcctcatgtcccataatccccaccaccaccacttgattccaaccatattgatctcttttctgttcccgaaatacttcaagctcttgttgccccagcatcttcaaacggactctttcttctgcctggagagacctccctccgtcttcactagctatcttttgctagtctataagttttgctaatcaaagcactttccctaacgtgaccacccacccagcctaagttagcctcttgctgtactttctgttacatcctttcatatttctttataaccattttaattgtactcattccatatttcaataattgtccatttattagagcattttcttggtgcgtatgttccttactagattgggagctgccagatatcaaagaccaactatgtcttgcttaccgcagtgtgcacaccagctagtacagtaacctacatagggtagagatgcaaaataagtattttgccaatgaaccatcacatatttattgaatttttactgagacaggcactgttttcgcattagctgcactttcacagagaatataatttaaattttacaacaaaaaccttcccccatcctccgtctgtcaattcttccttcccttcttcctttcctttccttctttccttccatcctcccttctcagcttcccatgattcaagtaattctttttaacagtctttcttcttaagcctccagatgatctctagaacataaataaactctaattgaggaaaagagagtgccatcttctgctccatctctgctctatctaagctcaatcttccatcaatccttttcctgtccacgaatctccaccatttgttttctcttgttcaatcactgccttctccgtaactcatattgtccttttaatcgtgctttgctctctgcagcatgttgactccatttatcactcagcgtatcccatttctcttcattcccttcagtcaccttgctctagacactctcttgacctgagttctgccaacctcttagcatcttgacctatgccgaactcagcaccgtcatctagtttggcatcagtgacaaaactaaggtcaatcctgaagcttttatttttattgttgcaggatccaaaatacactgctgtaaatatggttatcactgttatttaattctttgaaaccttctggtgagttaagttcaagttattttctctaccacttactagtttgctgatttttaatgagactcataacctcttttagacttaatttcctcacctataaatggaggtaatgggaaggctgaatgagccagcaggtgtaaatgaaagtatctagtgctgaccaggtgcagtgactcacgcctctaatcccagcactttgagaggcagaggtgggcggattacttgaggccaggagtttgagaacagcctggccaacatgatcaaaccccgtctctactaaaaatacaaaaaaaaattagctgggtgtggtggcatgcctgtaatcccagctactcggggggctgaagcaggagaattgtgtgaacgcaggaggcagaggttacagtcagccgagatcgggccaccgcactccagcctgggcgacagagctagactccatctcaaaaaaaaagaaaagaaaaaaaagaaaagaaaaagaaaaagaaaaaagagaaaaaaagtgtctggtgctgtctggcacatagtaggtcatcagtactagtagctactttccacctccaaatgtctatttatttggtccttctgtgacctctgtctctttgcattcatctctccacttctcatttccattttcagaacatttccactatgtctcatttagagcaaacttttaccattgtctctaacttctctttcgtgaaaaatgaaagaatattttaatcaccattgtcgttcttcatttccacttgcatctgtttgactgatttctgcttcaacccagcacttctctgactctttcccttaacaattctcaaatttattatcttttttctccagctcatacctttcactacctcccactttgtctgtccccggtcctctaaatcaaccccttcttgttctgtgatttactgccttcatttcatatccttttatagtcaaaatcctcacaatactcctaaaagtctctttcctcactcattcttttgcattttctttctcaagtccactcaagtttaattcatcttcatcattcatttgcttgtacccaaatctctgtacctttttgcctacttaatcatttaacctattcgagtttccttttgcttctgttacactgtcatctttcatctttaacacatattaatgagcaatgtttctttggactttttcttcatacaaattctaatgctggtgtattttcaggatcctcttcctgggtcccactaactttaattcttttctggaatcttttctctgggaatctgctttagttagaaaaaaaagaaaaaaaaaggcctgcaggatctgctctgtatttattcaagctatgctgctatcgtggtggattcaaatgtatattactggtgaaaagtgtaagctttattctcttctatagagtactaggtcattctcctttctgcagcacactatttttattattattattacattttgaactggtcaaggcgatatcagcctagattcactgtttccataacatttactgaacacctactgtgtgttaaacacaagctattttttttttcttatttaatgtttgcaagcctgtgaatttgggatttttaattcttgttttacatgtgaagcatagagaacacatagagaatgcacggcctgcaatatgttggcaatttatatctaataaagtccttttaacttttttgagtgagacagtaaagtgtaagagttaagagttgcatactttataacagggatagtgacaaccactttggaggagtgttatttaatatttgtcttccctcctaaattatagtttccagaagggcagaaattctatcattcttgttctctgctctcttgtatatattaggccatcaatgattattgttgaataaagaagtagataaatgaatgtatgctaaaagtacaattttttgcataagacaacactggctttgaatttcagctttgccatgtaacaaatttgtgaccttgaacatactagggagaaagcagatatcttgtaacagtctgcatctttaaactttgttgatatatgtcgtcctatacatgttgtttttaatttttatgcaatattttttagcaatactcagagccaggaaagccaaggttcaaatcccagttctcccacttcctagctttaatgccttaggcaagttatctatctcttcaagtatcacttcttcatctataaaatggaaatgatactacctctctactatactcatgggcaggtgccagtgtagttgatgatctggaatgaacacacgagaatgcctgatttcaagtactctgtactttttactacacaagaattctcgttgccctgacttccagctttaaagactgctctccttgtttctcccactatcttaagagctttatataaacttaactcccaggactatgcctggatgtttctcaaggaagcagaggccatctcccactcctgacccagataccaagctctatttgatgactattgtatgataatccacagactcagcaaagctggggctctgcaggttccctgtgactcctgaagcttcagcctcactccatctaattctaagaggctttcagagaaatctgtggaaagttatgggaagtccctctgttcctcctcccagatctagggcatttattttttaaaactaaggctgtggtctacagagaaaaaaaaatctaaattcaaaagagcactctctcttttctcactccttccctccctctcattttttcatcctctcttcttcatggaatattggggaatactattttccaggcatgtggataacaatgatgaacaagactgaaaatgatccctgcactcatgaagcttacagtctaatcaagagatagacaaatacaaatatcaaaaataaatatatgattagaagtttttaaatacgttatgctgaaaaggtatatggttctataaaacagaataatgagagaggtcttcatttatattttggggctaggtaatgtatctctgaaaaagtcacaatttattagaaacaaagacagatgaataggaattgttatggcaaaggaggattcccacgggaattcaaggcagagggagctgcaggcgtgaaaggctgttagagaaaatgtggcaagttctaggaaccaaacatttaaagtcagtatgtcgggacagttgagagggaagactagaaaagaatgaagtgagtcttagaaagttagtttggctgaagctattcaggcttatgtaggccatgataaggagtttggatgtaattctaatttaagtggaaagctatggacaattttaagaaagagaatgacataatcagaactacattttttaagcgttactttggatctatgtagaggatggattggtttagtgtgagagaggatcaaggagtctaacgtggagcctatcacagctgtccagatgtgaacacatccaggaggcagacttacccattacaacctctcccaccatggggtcctgtagcttgctcaccctaacagtggagaattcattatctccactgaaaactggttccacttgtggttgaccttgaccaagagaatgtactgatttatatcttctttattggatgtaccatgtattgattcaaattccatattctggggaagccacatggagcaaactttatgaaaattctccaagtctctgaaggcatctatctttttgtccctttcaaggaatgactgtcctcgtcagctgcctctactattctctgcctgggttttagaagcaacaacaatgagaaacaataattaacaataacttccatttaaatggagtgcttctacattcatcatcatgacatttgatttccacaaaaccttgtgaatccaacagaacaggaaattttagcatcaacttacaaatcacaaaaagaacattcaaagatgtaatttacctgagatagggcagataataattggcagaatcgagtcctgaatcaagtcttccaactcttacttctatcttcttttcatggtagagtgagcatggagcacagatggaagataagctcataggttttggcattagattgattgtctaagtttaaattctgactctgatatttgctgtgtgaccttaggaaaagcacttaacttctctgaactttggtttcttaatctgagaacaagagtatctacctcatgcagttggatgaggattaaatgaactagtagattaaaagtatgaagcacagtgtctcacctatattaataatcaataaatgttcactattatcaacagcttcaatcatcttggtcaaaagccacagtagcaaaagaaaagttgctgcagatttgctataaggtggcttagcttagaatagtaactctgctgcagtatcatgaataaaatgtttaatcaatgacttagttcttcatctgtaaaatggaaataatcatatctagctcacaaagttgctgaaaaaataagtaacaagagaaattgcctagccccaagaattacatattcaataaatgttaccttcctttctctctgctttaacactatttcccctagcaagacttctctgatgccctagactgggttaggtactcttcctctctttgctcttagcactttgcacttacctggagcagaatgtagatcatgctacaattaatgtatctactcatctgtctccactttgagactggagctgctccatgtgcctgttaactattctaagcactttgaaaataacaacccagttaatcctcatatgaactctgtgaaggagttcatgatcatcccccttcataccaattaaaaaataaggcaaggagagattaaatcacgtgtctcaggttgcatgtctggcatacagggggtgttcacttattccttcttgttggatcattccagatgccatcgccttaaaggggactcttgtggctcttttctccaaataactcacttattcaccataatatccacattgacattttctccatcatagctgattcactgattgattggtggacagacatctctcaccaaaataaaagctttaagaggaaagatattttacctgtcttgttcattgttgtggtacccagctgttaggataggccctgacacataggaggtgttcaatgagtatttgctgagtaaatgaacacatgcatgcatttcttaattgcttcacttatactgtaacttaaaaacaatggcctatgtcaaagcgtatgtctatacattcttgtgaaagtttgtagcattttaaattggagatgggttagggatgaggaagactgtagagacaggtaaagagtactcccttctgctctgcactgtctcctggactctaaatagcatcacttgtctcccagcagctggccagcaggtggggagagaccctccgctcagaaggcaggaggagtttctgctcaaggtgacaggagcaaagcaggaggaagctgcacagggaagagatatactgcagtcatggcattaaacctgaggtttgcgatgcccactaagattcactgggaaaaaataatactgaaaaaagtgtaatgtctagtatttatcacctcagtctactggtagttcattctccctgacatctatggagattcttaggaactaatatattgtctaacacctaccctgccaccaatgcactatgtactttttttttggttagctttcattctcatctgttattctctaattaatttttgttgctttaggtcttatgtaacccattagcatggcattcaagttcccaaacaacctttctgatctgctttcttgttgtttttgttcctataacccatgctctcatcaaaataaatgtccttactgttctctgtacacattccaatttccctgttacctcagtctaaattatttccctctgaatagcactctgcgtgcacatacagcagccatccttcaggggcatttttgattctcatcatactctgtatatgtaatagttttttccccttatatgtgattattcatcacataacttatttattacatttaataatttctatcacatatgatactgtagtcaaggctgtgatgaggataactatgattaagaagactgaaaatggtccctgcactcatgaagcttacagaaaatattcactctctctcctgtcacttccccagagcccactgatgttgatcttggccatgcgacatgaatcggctggtgagatactggcagtcatgatgtgaaccgaggcttgcatagtggggcttcctctttgtgtttttgcattgccgtgagaggaacatgctctgccttgcttgctggtccgagtagggtaacagacataagagcagacctggacctaacctgaagtttgaagacaagcctcgccaagacagtgtaaatcagcagatccccccagcctgctttcagatgtttgaatgagaataaaggattgccactttaatccactgtttcaaggtggctttatcacacagcattattgtggtaacaaatagctggtgcaaagtcttcacttccatcctatactctgaatttcttgaaactagagaccatctgattcttttttttttaactcatgcaaagttccaaggcacaatcctaatgcatatttattgaacaaatgaacaaatgaataaatgaatgattaaagagctctagagtgagagagagactcaagatctaggagactaatgtacttgtaagttcaacaagaatttatctaatacttattttgtgtcaggtattgtgctataggaagggtacttagtagtaaacaaacaggacttggcttctagttgccacttagtggtacaggaaagcttgagacctggagattcataatgcagtcaatttgcaaattctgattatccttgaattgcatgcaagggcaccacaataatcagagaagtgataatggatagaaaagagcagaaagatccctctgtcactgctgattcccattatctcaggttaagagcaaattctagacagatgggaggcatttgcatccttttgaagaaaatgagttagtaaaagctggcccatgggataaaataaaaatctctggggaaaggtattggttggtcattttctgattgctgaatgacacctctgtcactttctactattatcgacaggctatcagcatgctgagtctaaatgtcgttaccatctgtgaatcaaaaacctggatccatgacgaccaatctgacagtgtggtctcagtgaacaccagggactctgtctgaaccttgataaaaattactatgtgtctctttcctgagagcttttcctgattgttaagcattactgtcacactctcctgcctaccctacccactcactccaaaggtgttgtcaaggtagcttgtggcagatgccttccattttccaacagaagaagctctaggaaccacaggcatattgctgaaattcttaaataatggaaggcatcaacagagccaagaattaagtccaacttcccttgccctggacactagccactggggagcaaaattcatccaacatgtgctttgatgtcacccaaaatattttttttctgtttgtgtctatcttttgaaagaggaagtggctaggacagatggactattagagagaaaaggcaacttttgcagggctcaaaggatggcactccagaagaaatgcatggctgtctccacaactagcacctttcagcttgaaagaataagttgggccattttaccttcttccatatatgagcaaatcctaatgaggactgcagccataaagaaataaacttttagcttaggtagacaaacattgacagagatctattttcaaatcactatgcaacttaaatgtgataatgtacctgcagcatttagtatacaatttggcctatggcaacaataataataataataatgataataataccatttattgagtacctgcaatataccaagcagtatgctaaatgctgtcgaagtaccatctcagttagctccttcaacaactttaagagctgggaactttaagtatcttcattttacatatgaagaagctaaagctcagaaagacaaaattccttatccagagtcacatagctagtgatggggccaggatttaatctcatgctgtcccactccagagctcctggttacagacactactccacattttctctcataattgagaagaaacaaacattattatcatcgtcatcattttcaatcataatcataattaacaagtgtcataacaagaaaagtcactgaatgagggtagttttctagaatattataactaaaagaaactgttgattgaaatgaagatgcaaatttaagtgtgatctttggggcaaaattgttggagatgtgtgaaaaggaacggaaagttcttttacagtgcaaaatacttggctttgacttcacgcagtagcctaggcaaggtactcccaagtcaattgaaaaatggaatgcagtagattatgttatagccccgattcttcacctctcccctgtctgcaaactctgccctgtgattttgcagtttctcttactaaagaggcacagtctattcccccaccctttaaatcagagcttgaccatgtgacttgttttgaccaatagaatgaggtaaaatccatcgtgggccagttttgagccttgtgtgtttctgcttactattttatgcttctgcactcaccaggtgcaaatgcttgggccagtctacccgccccagaaggaggatgagaaatacatgcaacagagatttcccaggaagggggcctcagctaagcccagcctagaactgaatcccagctgacttgcagacccattgatgagcccaaccctgatcaacagacccccaaccaacccgctgacaagtaaactatgattataaataatcattgtgttaagcctatgcactctggggtaatttgtaatgcagtaacaggtaactggcacagagaataatcatacatattcatgcccaatgcgtggcatatagtagctgttggaaaaaaagaatagtcccctttcataccttttcaaccaatcagaaaagtcccagctcatcccagtgaaagttgcaaaattatgttaagatcattagtcacaaagatggaggaagcaagttcaggaataccatttatcaatgcttctactttggctccttgctgagaggagagaagcaaagcaacggctggaacatggacctcctgcactgggggcatgcagctccaccatcgacacgcaggtggcctgacagcctcagagcaggttttcctggaataattattcccattgccatgattggttatttctatgtcaaagtcacttccccttttcactcctgatttttcatttttgtaaaaatgacagtgcttgatttagctcttggaagaggatagggaatttggggaggtgtagagacatggagcagaaagttgaggaagggaacaaaattagtcatcaaaatgggctttacaaatataaagtgctaatgaaatttgaaataacaacaataattatgcttccaaggccgaagcctcacatttctcaccatgaatattcattccctgttatctttctaaggaatgaaaattgagtgaaatagcaacatgcatgtagggtgttgttgttgtgtgtgttttctcttcttctatttttacctggaccaaggccagcccctggcttgagactgtatttcagtatttttgtagctatgatttgtttcactgggtgtccatgtgcagacatcttaagtggaagatgcttcaaaagtcaataaaatgtaagttaaaaagaagtgtgtgggtgggggagctgaaacaactctttgtagctgctaaatggtcacaggtggaatatcactttgacttagagcttggcagccagaaatctggacgaggggatccaatgcatcttttaacaactggcatggaagattaggaggctattgctaagttatcaatagacggtgcagtttgctgctggaagtggtcttcaattgacttctaagtgcagaagttacatttgtacaacaacagtcagtataaccaactgtaaatgtatatacaatggattagtctgttcaggttgtcataacaaaatcccacaagctgggtggtttaaacaacagaattttattctctcacagtcctggaggctcgaggtccaagatcaaggtgccatctgggttagtgtctagtgagggctctctccctggtttgtaggtggcactttgtgtcttcacatagcctttccttggcacatgtgctcaaaaagggggggagagaaagggagaggggggagagagaaaaggagggaagtgaagagagagtgaacaagagagagaaaatgagagaaagagagataagagaaagatatcttctacttataaggtcaccagccccatcagattagggtcccattctcatgaccttattgacttttaccttctaaaagccctatctccaaatacagtcaataagcttcaacatacaaattttgaggaggcataattcagttaatagcatacaatatagtcaactgtctctgccagctcttgtgaaggcggcatggttcccgttgtcaccaagaagaaaataaaagg

SEQ ID NO: 83 - DNA, 171745 bp, Homo sapiens
aaaatgcacccataagatatgtttacctgtctcgctattttcaggcagagagtcatattctgagggacccagagcgagagcgttcatgtctgctgggtccgactcctgcgggtctggcaatgcggcattctcatggccctggtcaccatcaccattggcatccgatcctacaattaggagtttaccccaaaaaggcagggttagaagcataactttctcttaaaacaaagcttacacttgcagtgactcaacttctttagactgtaaaagacctctgggctctcaagcactgccacataccatgacacagttatgaatgaacaacatcttaaagacagattaaaatggcaacaaaagcacaggcctgaaagcagggggctgcacaccacggccatgctcaacttaccctgcgggccacggtctgcgtggtggccagccacctcctcccatgcagcactcacaccgtcagcagcactgcttgcttccagatgtaacacaggagccccccacacttctgcattagggttcagctctgaaaccttagttgctggtacctaggaagaaatgtaagatagacatttgtatccaaatgtcaaccaaatacaattttactcattaatgcagagttaagagacatcagatataggctccaaaggctcagcctatgtatttatacacacctttggaatgaaatcaggttcaaaattaaaaaaaaaaaaaaagcagtcagaattccattaaattccccccaagttttaagttcctcctcccaagaccaaggcttgcagagatggggaaggacacgcctgccaccaaaagattcagtgtttcacaaactatacctgaggaatagctggtgacttcctagactcctaataaaatcacaattcagggttttacaaacttgaatacaaggcagatgaataaaattctaattagaaagcttaaacaagtcagcagggcgcggcggctcacacctgtaatcccagcactttgggaggccaaggcgggcggatcacctgaggccaggagttcatgaccagcttggccaacatggagaaaccttgtctctactaaaaatacaaaattagccgggcgtggtggcgcatgcctgtaatcccagctactcgagaggctgaggcaggagaatcacttgaacccaggaggcgggggttgcagtaagctgagatcgcaccactgcacccaacctgggggacagagcagaactccatctctaaaacaaaagaaagaaagaaagcttcaaaaagtcacataaacaaaaggtgtagaagatgaaaattgctcctaagaatgaaggtgttctaacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacacaggagaagggctggaaaggaccaccatgagccgtcaaataaacgatgggtgcattaacaatttttaaaagacagaataaatccacattggctcaggtgatggggctggtagtaaaaaacatgaaactatttctgaaactgagagaaggcagctgatgtggtttgttcgttcctgctcccccagtcactggagcaccaatgagcaccatgcccataaaaccaggtgtttaaatgagtatctatctggaattctttttagtttttgttttaagtactggtgatagggcaaattattgggttccttcaagaatattataatcaagaagcaccaattcttcaattttccttcttgcattgcatctaaacttcatttttggcctctgcttctgcatagtgttacttgccctcttctctctcatccacccatctgtccaacaagtgcctctgacatgttcaccagcatgcttgtgccaggcacggcactgagctggcaggtgtgatggtgaaggaagcagacaggagctcatggagctacatgagggggcaggagacagccacaggtcacccacaacactgcctctggcagcgtttacgccgctccacctgatctgttgtctttgtaaattcatttctctattctctttcccactctaatacttccatacatcacctttcctaattagacccagtctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaagatatatgaggaatgaatcaatgtttaataaataacataaatttatattttccactatttgacaacttctgcaaggttttatgccacaaatgactaggactctacccttaaccaatgactacctcttagtgaagaagtccaaatcaagtgtatgcagttaggaaatgttcaatcaatgctgtgactgaagagatgtcaccaggaatgaaagaatgaagatgtcttttaaggcttaatgacattcaaggatctaccacgtgctgagcacattctacgcacttccttgtactgaatcagaacaagtcttggaggtcgttattcactggactcatttcacaaatgaaaaaaccaaggcagagaaaggtagagtaacttccccataaaaacgatggtaattagaaagttagattctaagcaattgcgttcagcaaaattcaacactcatcaagagttcattaacttataatttatgagaaatagtttgtattaaacaaagatctgaatctcctactatttctataaaatatggttattctcttgcagtaatatggaactctaaatggttatcaagaactccagcgtcggccgggtgtggtggcttatgcctgcgatcccagcatgttgggaggccaagatgggcagatcacttgtggtcaggagttcaagtccagcctggccaacatggtgaaaccccgtctctactgaaaatacaaaagttagctgggtgtggtggcacacacctgtaatcccagctacttgggaggctgaggcaggagaatcatttgaactcaggaggcggaggttgcagtgagctgagatagtaccactgccctccagcctgggtgacagagcaagactccatccttgaaaaaaaaaaaaaaaaaaaaaaaactccagtgtcgtctgcttgactataagtcttatttttccattaaaaatgtatggctaagcaatggttattaaaaccacaggcaagctgaccttaacagccacattccaaagtgaacatgcctgagttctgatgctttaaataaacccttccaccccaccccatcctgtgcgaaacaatatgctccactttgaaaaataacgtatcaattaataagcttgtataactaccgatacgagacagaacagtctctctgacaagttactgactaggaactggagtaattaatgctggagaagggggactggccggtgaggtacagaaagcaggtgagaaataggggaaagaaacattccatgcaagcaccaaccactcctacagatgcactaaaaagcttagtaattcagggcaatttgctgacttcagaaccatacaaggctctacctccagttctttgtgaaatggagtaatagctgctatattaagatttgcttaaaaaaaaaaaaaaaaaaagacacctgtaacagcactttgaaaattgaagctctgaaaggcaaggcaccatcgttaaacgtggtaacgcttcgtatgagaatactgtttgggaatacctcataatggaaaagctaatttaaaactggaagcacacctctcacttaggcatcatttatgctctttgttgatgtctgaggcagtgacactggtaactaactgaaaattatgtcacttctgtaaaagattaactgcagattatcttaaagatgtagttttatactgttttgcctccacaactatttaaggagcaaaactaatgaatttgaacataactctctccagaaaaactcccagtgtgggcacggaaataaaagaggttgatggatcattccttacactacagaaggggatttctacttgtttatttccatatagtaagtgttgacatttgagccatctctacctccttaatatcaatacttttccttgcttcattgcccacaaaaatcatgaataaaccactggttgaataatgagatcttgctactctgagtatgtgctttcaatcacactgcttcgataaatgtctgttttgtggaagaaaactaatttcctgttgttgaatgatgttgacatttattacagaatttctggaaagatgctcaaattagctgcccatagagtcatttgctaagcttcttccaaaccagagggacagccttatctcggggttctgaaaaagaaagagctccacagtaattctaactgcaagaagacagaaccaagatttcataggcagttaaaagcagcaaattctacctgcctcagacacatacaaagatataaggaagcacagatttttaggtaagtttgtcttctgcagtgtgacttataccttcaatgggctcacatgcttatcgaatcaactacactgcccacgagataagatgccctcaaagggctctgacaacactgcggccaggaagacagaagagctggcaaaattcacagacagaaaaaagtcaacacagagctcagggcatgctttagtgctaacaagagtttgcacacaacctctggcttaagtacaccaaacaagaattcatattctccaatttggaaatcattaatgttatagtaattcacagccatatataagcattcaaataactacccactgtttagagtaaatctttattaattttaagttaaaaacaattaaaattggccagcccggtggctcatgcctgcaatgccagcactttgggaggctgaggcgggtggatctcctgaggtcaggagttcaaaaccggcctggccaacatggcgaaatcccatctctaaaaatacaaaaattagccaggtgtagtggcacatgcctgtaatcccaattactcgggaggctgagtcacgagaattacttgaacccggcaatcacttgaacttgggaggtggaggttgcagtgagctgagatcacgccactgcaacttgggtgacaaaagtgagactctgtctcaaaaaataaataataataataataataataataataataataataataataataaattaaaatgtatagcccagcataccgcagcacaatagtaaacacacagaaaacatacttacgaactgtccgtctctatcatgccatccccaaacaacaccgtcctctgacaccggtagctgaggagtgttttctgaaaacaaagcaatttccaaggcctgtggcttatggtgcagatcctcactaaatattgtttcaccttctagagcaccttttgtgactgtattagtccagagatagcccatttgatatccaccacaaccactggccagtctttcagaaaatgctgggtttcctaaccctcccatcgggtaataggaaaattcactcaaaaaacgggagactccttctgggaaactctgccaatccacttttgagggatgttcacatctatttaggacaccttctgtgagtgataaaatgtggccactacttggtacaatcgtgtctttgctgtccacggggacagcgggaatcccctgcgctgcatcgcagggggcacctgtgtatctgtccgctagggtgggatcaacaccaaccagaaagaaattgccactgggagtgtcacgtgactctattttctcaaaactcaccttagcatttcccataaaacccatttcaccatttaaagtcgactgtgtaagagtggacttggcgtttccttctttgaaatggtgtgcacgttcactcgtcccacatggacccaggcagtcagtaattctggggtcaatactatctttctccaaataaagtctctcttcctcttctttacatgttagttttggtttactcaaccctgatgtattattaccaaagataccagaagcttcttcaattgattcagaggaaattcccttccattttgggcttttaccaccactaacagaattctctactatttctgacttctgtataactggattaacacttggactgaaatgtggtaacacactaagaacattatatttgcagtcgtatactcggtgtgtttcataacttttttctatttgattagtttcaaaatcagcgttctctgttgcactagaactaacacaggagagtacatcctgacttggcactgcctcatgtctttgtgtacctgtttcccactcataggttgttttagaatctgacttgacagtctctatgtcatcttcacttgtctcactatactttgcttgcagtgattctttttcactaccttctaacctttgagggtcactcagctggtctcgtgacacactgactgaactcttcacacatatttcaccctctgttttgtcacctgggcttgtttccctctcttcttcctctgtgcaggtgaaaataaatgcggaggaaacacagttactgtgaagagatctggagtgactgggagacttgccatcggggggcactccttgtgccatgctaagctttaggccatctgtcctctgcaccgtcccctgcgtgtccaccacacgctccacacaagtttggtcacaggtctgtgttgcagcctcatctgcttgacaccaagattttgactcaaaagcccttacaccatgaccctcagccttccaaacgccaattctgtcctcttcttggtaaaaggcactattttcagattgcagagacacctcacctctgtctggcagcaggggacttctggcctccaggctgcagtcccctctgcgctgtgccttcctgacttgtctggggacaggttccggctcccagcagtcatcaagctggcttggggctgcttctcttgaattagcgtgacctgagagacacccacttccaaatcttactgcagtgataggcctcttaggacttaaatcaattctatctagaccaacaggaaggatactatctgctttgttaacgtccaagtagaaatcatcgttgtctcttagtggtgtgatagagttattttctctctcctttttagaatgtaaactctggtcgacaacaactgttaccacctccgggtcatcactccctgcaacacatgcagtgtcagtacaaaagctaccaggtgaatgtgcagtgtcagtacggaagccaccaggtggatgatccatctcacttcctactcctgagttacagctctcactttctcccaggacacacgcatgacttagtgagtcactgtccatgttgttatttaattcagggagtaggtcaataccatgtagtgcactactttctgcgtaatttttagggaattcagtgcaagcttctgcctgtaaagcctccatctgcacgttatcagtgtttgcttcacaaggtgcatggctgaacgccacaggctcagggcaaggcttggctttcccactgcattcccctgtcctttcacctggacccagcgtgtcccaaggcgagagttcttcctgccgtggctctggctcgcccgcccctgacatggcacgcgaggctgaaggcactgaagagcaacactctcctcttgcagctactgtgtctacccaggtgcccagctcctctgccacgcttgggcaggcagagtcggcaacacaaatgctgtgaaacttgcactctcctgaatcctgacattgctgatcatcaataccaacagggtttccatctttcctctccctatcggataggtctaaagacttactctcatcaccactgctgaggtgaacgctgaccaccatttctttctctactaaagagtttttacaagtagctgggtaacagtgcagatggccactcacaaaggcttcctcctgcaggcctcggtcagaaggcaccagcacacatgagaaaagctcctcatcttcccaacaaccttgtcggctgccgttacccacacacagtagatcacagaccccctcagaattctgctcattaacaacaatatctgaattcttgtcattctcacccaagttttcataccttgttgagaatgtatatataaaagaggaaagagggttcaatgactgcttgggtctatgaccctgtttgtgcccagaccctgcgaaaatccttgtccgcgcgctaacgccagctacactgctggctccactgccagtacggtgaacctcctcacctttgacggtatcaaataatgaagacaaagttttacttatcttgttttctggttccttttcctccacagatttttgtaacaggccagttttttcactgtcattgtcactacttagttctctgctgaagcagcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatcccagccagaaagatttcaggcttctggtttttctacagtgttccagtatttcccaaattatatttcatgggatggtggtaactaaataaaatagttcataaattcccccaaaggaaaacagtatcagaattttgttccgtaaaatatatagctactcacagttgtatctaattttctagctttacgaaatgatgtctgaaataaatagcaatttaaaaagagacgaaaaaatcaaaggagagcaaaaaaataaatagcaataaaaaatagtatctgtaggtatcaagaaattattactaattgtgtcaggtgtgaaaatggaatgatgtcagttagagatgcatgctgaagtatctgggataaagtgacacattatctacaatttgctttaaaatgccctagcaaatatagtaaatatatacacacatatataaaagttaaaacagtcatgtgcatacagggaggaaaagatttaaagacagtagtccaggccggacgtggtggctcatgcctgtaatcccagcactttgggaggccgaggtgggtggatcaccagaggtcaggagtttcaagaccagcctggccaacatggtgaaaacccgtctctactaaaaatacaaaaaattagctgagcatgggagtgtgtgcctgtagttccagctactcggaaggctgaggcaggagaatcacttgaacccaggtggcagaggttgcagtgagccaagattgcgccactgcactccagcctgggtgacaagagtgagactccatctcaaacaaaacaaaacaaaacaaaacagtagtcgaatgtggcgatgggtaatgttcaagttaatgatgctgcatttggttcatggtattattcgctccacttctgcagatgtctgagcactccaattaagaaaaaggaaggaacaagaaaaaaaagggaaaatagatctacaagctctggtaccagaactagaaagtctcttgaaagtacttgatgcaggaacgcacagcctgccatctggtgaaaaacaggcgttgtccacaactaaacaagttgctcatgtactatgtggtccagtccctaactgtggactcacataatgggtcttgtcttacattgacatctgtgatgttttgcttttagtataagtaattctttttcttattatggttctgacaggctatgtgaaaaacaaaataattcttttagttcctctgcaagagagattttgttgtttctttaacctatgagttatgactggtgtcctattaatgttttactttttaaaaatattaacatttttatgataaaaagtttaggaattacacttaaacataaaggtaacaagaacacttatgaatatactaaaattcaagtactgaaatcatcataatgattatgatgataatggtagtcaacactttatatagcactatgtttcacaaaatattaattacatctatgcatccattttgtcacacgtcttaatttgcacccttaacaacccccaaggtagatactactaattcactgtacagataagggaaatgaggcaccaagaactttagtagcagcttcgaatgacaaaacaaaactcagaccatacattgaccatactgttatgctactcaaagagaattaaacatctacatggcaaaaacgttctgcactaaagacacaaacgattcataccagctgtaaaatgaaaggacatagtaaagcagagaagctcacgagatcacctgcctggctttgagtctcagctccatttttacatgtgtcatctctggcaaattatttaacctctttgtctcagttttctcatttgtaaaatggagccaacaccgacatctatttcaaagagctgttaggcagactttaagtagttggaatagaatctcagagtcccacttcaaagtcccccataatctggccccagcctacctctatgatctcggcttctaagataccattcccccgacctcttctatctcatactaaccaatgccagcacactgcctcaatgttgtttctttctccagtctcctccccacacttttcaagccttgaagtcctttgtgaaaccattctgtgctgctctaacagaatacctgagatggggcaatttataaagaacagagattatttcacacaattctggaggctgagagtctcaagtcgagaggctgcttctggagaggcctttgtgctgcaccatcacacatgtgaggaaatgcagtcactcccaccacaatggcactcatccactcctccacttgtgagggcagagcctggtgtccttatcaccccttagaaggccctacctcccaatgctgctgcacggcggactgattttccaacacatgaactttgggggacacatgaaaaacacagcattccattccagctcccacaattcatgtccttcttataatgcaaaaaatactcattccatcccaatacctccaatagtcttaactcatttcagcatcaacttaaaagtccagagtctcatctgaatcagatagggtgagactcaaggcacaattcaccccaagatcaattcctctccagccctgagtgttgaaagtaacaagttatgtgtttccaaaatacaatggtgggacaggcacacacacaaaaaaattcccgaccaggtgcgatggctcacgcctgtaatcccaacacttagggaggccaaagcaggcggatcacctgagatcaaaagttcgagaccagcctgaccaacatggagaaaccccgtctctactaatacaaaaaattagccgggtgtggtggtgcatgcctgtaatcccagctacttgagaggctgaggcaggagaatcgcttgaacccagcgggtcagaggctgcagtgagcagatatcacaccatcgcactccagcctgggcaacaagagcaaaactccgtctcagaaaaaagaaaagaaaaaaaaatctatttccaaaagggagaaataggcaagaagaagcaagaggtcccaagttcaagacccaacagggcagacaatattaaatattaagcctctctggagaatcatctcctttgactccatgtcccaaccctctgggcacagtggaacagggttggctccccagggcctcaagcagccccacccgatggctttgctgggctcagtccacccagcagctgtcaggggttggagtctcctgcccacagctctcccaggctgatgctgcaagctggcagctccacagtttaaggctcccaggccactcccatgactctactaggcaatgccctggtgggggcttctctgcagcaggttcaactccaaatttctgcttgccattgcccgagtacaggctctctgcagtggctctgctcctgtgacaagtctctgcctgggcccccaggctgtccatgacatctcttgaaatctaggtggaggctgccccacagctctagcattcttcttgcctgaaaaatcagcaccacatggatgccaccaaggtttatgacttgtaccttctggagccgcagctcaagccaccactgggcccactcaagcagcagctgaggtgactaaggagcaatgcacaggatgtggggagcagaggtccgaggcggctctgggcagcaagcctgtggagggcccccagtgctcatctaccaaaacccttctgccctcctagagggcaaatgtgatgggcctgtgatgggggaacagccttaaagatatctgaaatagcctcgccaacacagcaagaccccatctctacaaataaaaattaaaagttagctgggtgtgggggcgcgtgtctgtagtaccagctacttgggaggctgaggtaggaggataacttgagtccaaaagttcaaggctgcagtgagctattactgttctactgcactccagcctgggtgacagagcaagaccctgtctctaaaaaaacaaacaattctgaaaagcctttcagatggctgaaagagctgagtgttttaaattatttccttctggtttctctttttaaatgaaataacggtgccaaatacaaagtatttcctcttgagtttggactctgaagccagattgcctgggttcaaatcctggttctaccactttttagtccagtaatcttggggataaattacttaaacctctttgtgtctcagtttcctcatttgtaaaatggggataacagtacctaggggtaagacaggtgtagggctaacaggaatttatgagtaaacggaagtgttaggagagtgcacagtaagagccatgagagtctgcagtgattaccaccatatgtgatatattcttttacactggagacatttatggagcacctacctgtcaggaagacactggaatacatcagtaaacaaaactaaaccccagatttgatggagcttgcattctagtccagggagacaaacactaaatctaacaaatacctaacattgttagaaggtgctaactgctacacgtaaagggtctgaggcaagccagaagtgaggagacggatgcggatagatggggctcgctgagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccgacacatctgtcgcttcctcccagtgatgtgactattctctcagtacaactgtttgcatggtactgccacacaaagttgatttataaatctactattgaacaaaatgccttaatagcaattaaactgaatcctaaaatgaaaaagagtttgcaaaaaaactatttgtcatattctaaatgatgcaaatactaagcaataaaattactaatttttttaaagaaattacaaaatgttctaagttgagagatgtttttactgatcccagtgccttgaaagactactattacatctgtcacacttccacaacaagagaagttttagcagcatgtaaatcatttacacaaggatacaactaagaatagtaagccaaacagagaatgaagaaatccctctatttttaaatatgccttggagctgaaaagatcacgggtatgtgttatagaaggcattccttctgtcagtggccaaaatgctacaatcaaaatgttacaatactatgtcatcaaaaagaaatatcctacattaaaaaggatctactccgtctcagcacgaatacattctaagaggaaaagagggcatctggtcagagtatcccccatcctggggcaagttctccgaagtaccaggagaccaagaaccgtgcatacactctgggggtaaatggattgttttgtcactaaatcatgctgaggtaaaggcagctttacacttcctgacatagtaacaaacatatttctaagacaggaaactgtatcaacatccttaaggaaagttcttaggtcttttgtttttatttttttagagacagggtctccctctgtcacccaggctggagtgcagtggtgcaatcacagctcactgcagcctcgacctgctgggctcaagcaatcctcccccatcagccacctgagtagctgagacagcaggcacacaccaccatgcctgttcttttttgctttgtagatatggggtcttgaactgggctcaagaaatcctcccgccttggcctcccaaagtgctgggatttataggtgtgagccactacatccggccaagtcttttcttttcttttttttgagacagagtttcgctcttgttgcccaggctggagtgcaatggcactatctcggctcaatgcaacctccgcctcccgggttcaagcgattctcctgtctcagcctcctgagtagctgggattacaggcgtgcaccaccacacccagctaatttttgtatttttagtagagacggggtttcatcatattggtcaggctggtctcgaactcctgacctcaggtgatccgcccgcctcagcctcccaaagtgctgggattacagacatgagccaccgcacctggcccaagtctgttcttaaaacagactgacaaggtggtaacaacctgccaaaaggtctaacctgcaagattaacataccaagagcagccacgtgtcacttgcgtacaaatacaggagttggatattttcatagaaattcaagctttctgattgctaagcctactcttattcaaaatataggcctgcaataattaatctgaattgctaattaatagttattcattcagaagctgtgtcatcaaaaggcaaaggtggttttttgaaaactgataaaggaagggactaaagttttttggtattaccatctgtaaaggagtttaaaaaaaaaaattctgggccgggtgcagtggctcaagcctgtaatcccaacaccttgggaggccaaggcgggcagatcacttgaggccagagttcgagaccagcttgggcaacatggcgaaaccccatctctacgaaaaatacaaaaattagccaagcatggtggtgcatgcctgtaattccagctactcagaaggctgaggcacaagaatagcttgaacccgggaggcagaggctgcagtgagcagagatcgcactactgcactatagccagcctgagtaacagagtgaggctgactcaaaaaaaaaaaaatcattctgatatagatgttttgctgaattgtacatagagtttagtatgaggatgagttagatttccaatttcagatttccagtttcacactatgattagaaaagacttgctgtgactttgcatctttcttctgaggaggtaatttaacataaacacttctacctaatattacctgtcccttaaacatcatcattcactcacattcctctctcaaacctgctgttgatttatgataaaacacaagaggatcatttcaacagaaaatggtttccaggctgatgtagtgtctccaagggaaaagcaggtacttggctggtcgcacacaggagtaagaactggagtccctgagtgggcttcaggaggggcaaaaagccgctgagaatgatgtttgctatagatgaagtttgtggcgctaacagggaaggtaaagaacctttaaccaaacgacactgttgctgaataccagtggtcagatattttttcttcctcaagaaggagaacccatcgctgtggcccactgccagtggtcactcttcatcataaacaccctcaaaaccctttcaatcccctctcgccttctatcaccttaccttcaaagccaagatcttaggaggaatgtcaccgtctaagttgtgtctaccactcctgtctctcacccactgcaatctggcttttgctcctatcagtcctgggaaatactcttgctaaggtcacaactgacccctcgctttgttaccttactacacttcacttgagtcagcctccctgcctctatctccaccccacactgtcctctggttttcctcccatccctctgaccactccgcgtcctagattccttcctgtttctgatatattgagggaatcgagagtttcatcactgtccctgcctggaactcaggtaaacttaatgcaaagtactgtaatcataactattggtacgatatacttcaaaatcagtagatccttatgacctcaaggtgagaacattcaaaatgaccttgcttgactaggggcaagataaagagtgcttcttctagactcacctacgtctcagtgcctcccacctccaggtgtacgctcatcttgtacctaaggctcacacacaatgtgatcatgcaatcttgcatgctgtgttagggctcctcgaagacgtgtatctcacgctcatctgaacaacctctccatagaaaatgtcttagccatcatgatcacttgcactcagttttgatgaatggatggatactcaaattttatgcaggcagtactagctgcttgcctaccagacacaatgcattgagctggccacagaagggaacagaatgtggagacacagagcatgtttgtgcctgcccaaggatgctcccatccttagagacagggcctaactataagtgggcctgggggtgggctgggggtttaatggggtaatgtaaaagttctaagactacattatggtgatgattacacaactcagtaaatctactaaaaataattcaattgcatactttaaatgggtgagttttacagaatgtaaattatactttaataaagtttttttttttaatgaacagaacacagtaccagaagtttacagtttagtggagaaaacatgtacacaaatttgagtaattctgacaatcatgtcactcattataatatattgttctcatactaaatagggaaaccatttttttttttttctgagacagagtttcactctgctgcctaggctggagtgtggtggcacaatctcggctcactacaagctctgcctcccaggttaacgccattctcctgcctcagcctcccgagtagctgggactacaggcgtgtgccaccacacctggctaattttttgtatttttagtagggacggggtttcaccgtgttagccaggatggtctcgatctcagggaaaccatattcttacagtctaatagagatcacttttttgtgttctttggctaaccctgtaaatagttactagctcagtaagctttttggagagggcaggaagctgtctaataaatacaactaaatagtaccagtggataaatgcaaatctgctcctgaattattcatgtatttctttgggtatctctattgcacgtctcctcctactcaactctgacagaatggctaaactgtaaatagcctggttcctcaaccctgactgctaaatgtattcacttgcccatcataacaactggctgagcactgccacctaatcactaaaccaatgcaaactcctggtcaactatgaagcatgtaactctccacacctttaggtgcactatgaacaatgctaattagaaaacattcatagcaatgcctacaataggtttctaaagatgtctgaatattatgttggactgaaagtcaaccacggagagaacaggaacttgttgaagcaaacaaactcccttaaagatttatactcaagggatatctactttatgtcttatataattttcttcttagactaccaagcgtcttatatttggatatttttaaaaaatcaatgtgcaccgggcacggtggctcatgcctgtaatcccagcactttgggaggccgaggcaggcagatcacctgaggtcacaagttcaagaccagcctgaccgacatggtgaaaccatgtctctactgaaaacacaaaattatccaggtgtgatggcgcatgcctgtaatcccagctactcgggaggctgaggcaggagaatcccttgaacccaggaggcggaggttgcggtgaccaagatcgcaccattgcacaccagcctgggcaacaagagggaaactctgtttcaaaaaaataataataaaaaaataaattaaaaatcaatgtaaaacagaatacataaaaattttacataaataatatatttataaaatataataatttagaaggtgtcttttgtttttttaaaattcttctttgttacaagctggccaggcatggtggctcacgcctgtaatcctagccctttgggaggccaaggcgggaggatcactttgagttcagaagctcgagactagcctgggcaacacagtgagacctcgtctctatttgaaaaaaaaaacaattggattaacaatccaactcctcaattcctacgtgaactgcttataatggggggggaatagatgagatttatggtaatttttattttttacataaaatatttttactttttaaattttatgcaatttataagatcctttgatcaaactgaatttccagtagtagctctctgaagcactttatatatgcatatgcaaatgatgaaaggtaggatttaaaaaccaatgaattctacttccttattctttcattaatcacagctaaaatgtgaaacaaattttctgagtaaaagcttactattcaatttgtgtggtttaaggaacacaagctaccaaaatgtaaagctactcatccgcatataacagattatcaatgatacaataaaaattttgtaatatttgaaaataaattaatctaaatggtatgctgctgttggcagaactgcacacaaaacagacacgcacagaagctagaaaggacatacagtattgacagttaccatacccaggggttgtggtgatgaatggatcccctaccacaactttttgagaaatatctacattttctaatttttgttacaataaacatttttcttaaggaagtatctctgagccttgactgtgattaaaaaatctgtgattaatctcaaaattgaattacctgactcaaaggtgggatggaacttgtctgagaagtggtttgagatataggaccattcatctgtaaaattgaaaacaaagacaacatcagtacaatgtttaaaaagaaacaacatattttcaaaccacagtaattaggcaaaactaaacccaccaagaaatgcacatttcacatgacaaattcatgaattcataagatattcagaatgtaggaggcttaaaatttttaaattctgaatgaacatcatagataaagttctttgtagattcaatggggaaaactaagaaaagctactttgctcaaagccactttggaactttaaatattactgcttgacataaaatgtttaaatgaacaaaagtagtcaaaaaaatgtatattaaaatcctaactctttaaatacatcctactatagtgactataatgttattaaactatttacaaatcactacatatccttgatttaaaaaataaatggatttgagtatctagagctataacaattttgtttttgttatcatctactacttatagtttcctctactaagctacctctacatttttcagactgatggggctcaggactttctccccaaaaaatatggcacattgacatttgaggaaacagcagaatcaggccatggaaactagaaagaattctccttgccccttctcccttgaagcaggccataaaacacagctgacattcccctgaagacccttccagaggggccctgctctgtaccaggagcagtaacacacagggatgtcaagaaaaacctgaacacaacagccttgctaagcttctccagtttattagctctaggtcacatcccttttgtccaatcatgcttctccacaactgtcaacatctgcattagacttcgcaaaaaaaaaatacagttttccctgtttctttggttcttcctttgtggaggctcccatgtcacatacaacttattactaaataaatgtgtatgcttttctcttgttcatctgtcttttgttgcaggggtctcagccatgatcctcagatgggtaagaaatcttttctcccctacgagactctaatatctgtatgcagatcctaagatgtgccagtgttcctgtttagaactccttactaactccaatatagagtcctttatcaaaaaaagcaatggactccccaccaccccattcgacagcacccaccagatgagcgctgtccttgccctcctggactctctgcgtctgcggttcagccacaaccttagcgtcctgatcagaagtcatgggctccactgggagaagtgtaatgctaacctcaggatgctgtaaaatggcaaagacattaaacaggtcatttgaagggcacagtatgattatttaaataaaattaaaatcctcaagttttccaggacacacgtttatccctctgaattcaaaaaagtttaaagaagtcttcccatatgcataccttactcaccaagaagtgatacttaattttttaaataagtaagtttcttcttcacaccattttggtgaagatggccacactctaaaacttggaaactcatgtgctgacacaaataaacccatttgtgcctggaaactcaagtcttttaaaaaacagaaaattgaaggcttaatatccaagatatataaggaactcacaccactcgatagcaaaataaataaataaataaataacctggttaaaaaatgatcaaaggcatgaacaggcatttttcccaagacaacagaaaaatggcaatagaaatacgaaaaggtgctcggcatcactaattattggggaaatgcagaacaaaaccacaatgatatttcacctcacaactgtcagaatgactattatcagtcagacaagagataacagggcgtggaagaaacagaacctttgcacactgttggtgggaatgtaaattggtgcggccattatgaaaacagtatggaagttgctcaaaaatttgaaaatagaactaccatattatcctttctgagtatttatccaaaggcaatgaaatcaccacctcataagaatatctgcactcccatgtggattgcagcattattcacaatagtcaagacatagaaaccacatagttgtccatcaatggacaaacggatatagaaattgggatgtgtgtatctgtctgtctatgctatggaattatgtattattcagcctttaaaaagaaggaaaccccgtcgtatgctataacatgggtgaacctgaaggatattatgccaagtgaaacacaccagcacaaaaacacaaatactgcatgatctcactcatatgtgaaagttactatcttaaaaagtcaaatacatagaaacagagaataaaatggtgactaccgccgggcacagtggctcaagcctataatcccagcagtttgggaggccaaagcaggcagatcacctgaggtcaggagttcgagacctgtctgaccaacatggagaaatccagtctctactaaaaatacaaaattagctgggtgtggtggtgcatgcctgtaatcccagctactataggctgaggcacaagaatcgcttgaacccgggaagcaggggttgcagtgagctgagatagtgccattgcactccagactgggcaacaagagtgaaactccacctcactcacacacacacacacacacaaaatggtgactaccagggggctagcaggtagggaggaaatgaagagatcaatgtcaaagggtaccaagttacagatattttggatgagtaagtctagagatctgatgtacaacatgaggcctatagttgtaatattgtattgtacactcgaaacttgctgagagtatattttaggtgctcttactaacacaaaagaagggtaaaactatatgaaatgatggctatattaatgggctggactccagtaaccatttcactatgtatatcaaaacatcatgctatataccttatgtatacacaattaaaaaaaaaaaaaaggtcagatgtggtggctcatacctataaatcccagcactttgggaggccgaggcggatggatcacctgaggtaaggcgttcgagaccagcctggccaacatggtgaaacctcatctctctaaaaaatttaaaaactagccaggaacggtggcgggcacctgtagtcccagctacttgggaggctgaggcaggagaatcacttcaacctgggaggcagaggttgcagtgagccaagatcatgccactgcactacagcctgggcaacagagtgagactccatcaaaacaataaaaaatacaaaataacagaaaactggcagggtgcagtggctcacacctataattccagcactctgggaggccgaggagggcagatcacttgaggccaggagttcgagaccagcctggccaacactgtgaaaccccaatctactaaaaatacaaaaattagccaggcatggtggcacatgcctgtataatcccagctactcaggaggctgagacactagaatcgcgtgaaccaggaggtggaggttgcagttagctgagatctcgccactgcactcccacctcggcgacagagcaaaactctgtcttaaaaacaaataacaggccaggtgcagtggctcacgcctgtaataccagcactttgggaggccaaggcaggtggatcacctgaggccaggagttcgagaccagcctggccaacatggcgaaaccccatctctactgaaaatacaaaaatgagctgggcctggtggcacatgcctggagtcccagctattcaggaggctgagacactagaattgtttgaacttgagagagacagaggttgcagtgagctgagatcacaccacggcactccagcctgggtgacagagcaagactgtctcaaaaacaaacaaacaaacaaaaaaaaaaaaacacacacacacacacaaacaaaaacccagaaaattacaaagttaataggactccagaaataaaaacagttgttgatgaatgctaaattcagatatatttaagtgtcctcacttaacatcatcaacaggttcttggaaactgacttcaagcgaaaggacgtgaagcaaaatcaattgtaccacaggcacaaacaagtgttaagctcctacagcatatttccagtcacaaaaatatcaccaaacttctaattaaagacccaaaactccttctaatatttaaaatggcaataaatatgagccacacacatttttaaaagattaacaagaaagacaattacgtacctaattttgggtgagtcagaaagtgacagtggtcatagtggtggtataaccaccactggatttaaccaatcaaggaataaatgtttgcaaagtgaaaactgtaagaatattacggcagggcgcagtggctcgcgcctataatcccgcactttgggaggctaaggcaagcagaatgcttgagcccaagagttggagaccagcatggacaacatggcgacactcatctctacacaaaatacaaaaattagccgggtgtggtggcacgtgcctgtagtcccagctccttcggaggctgggataggaggaccacctgagcccaggaggtggaggtttcagtaagccgagatcgcaccactgcactccatcctagggaacagaataagatcctgtctcaaaaaataaaaacaaaaataaaaaaagaatattcctaccaccaagtagttaaaaaacaaactatgataaccaatagggcaggctcactgagcactatttgttgtgcatttatattattatagtagactttatgaatttttgtttcacaacaatttatattgattcattcatttctcaacctgcttattccagttcagggtaacaggtggccacagcctatcccagcagctcaaggagcaaggtgggaaccatccccgagaggacaccatcccatcacagggccgctcacacacacacccacactcactcactcagactgggaccaggaagacatgcaaatccaccgaacatgcacacctttgggatgtgggaagaaactggaatacccgtaagaaaacacgcagacatggagagaacgtgccaactccacacagacagtggtcctggccaggaactgacttctttctcatcatgttgaaatgacattgaaagaaatgatgtttttcaaagtggttcttcatgaagcatttactcaatccaatgtctagacactaaacttcacatgtaacatctcactcaattttcccaaacaacgtaagaagtaactggctcaccaacactttgggaggctgaggcgggcggatcacctgaggtcaggagttcaagaccagaccggccaaagtggtgaaaccccatctctactaaaaattagccaggtgtggtggcgggtgcctgtaatcccagctactcaggaggctgaggcaggagaatcacttgaacccatgaggcagaggttgcagtgagccgagatcgcccctaaacatactctagcctaagcgacagagtgaaactctctcaaaaggatcagaagggataactgtaacaatcccgtatcctgaggattcctagacatccaggtctgacttcaaggcatttctttttactgcaagctacactgcttcccaaacaagataaatattgttatttaacccaggtatctttttaggtacatctgaaaacatacatcagactgtcagaaaaaatacctttaaaagtgtaactatttttgtcttactaggtagccatacaggtttttcatggtatagtggagctccctattcgcaataatctgcttgtgataaattctcaaaaaccttgttaatgaaataatctgatgatcaaaggcaatctcatccaattgtgtaaactgtatcatcaatcacaaaaacatctaaatgctatcaaaaagagctggaaataaatgtaagctagcagagaaaaaatgcttgaaataaatacgggatgtatgacaaatgttacactttaacagatatatttcattttaatgtatatgtatcttctttttatgtctgtgtagtaccaacgtcttcttattaaacaaagaaaagagtgaatcaatttaaataaatatattaagtactagtataaatgctatcgggactcaaaaagatcttgaaaacagaatgtgagtaactaacttgtagaagacacagatttcgggaacatctggactgagattctaggtccttggttctcaggcctcggatgcaatgaagaatccctggagcaaattgtgattttgcaattttgtagtttggacttttttattattattattattatttttaactatgtagatgattctgaaaaacctgagcaaatacttccaggtgatgttgaagtaacacacgaggggagtagctcccactccctgagggggttttctacgagagaacagatggattccattgtaaaagaaacctacatgtcattaaacatcaattcccacacaaccacgaaatccagaaactaaagacatattaatagtttagcaatcaaatgggcaagtcatagaaggcgctgtggatgcttttgccaacattaatttccagatttttaagattcttatgatagccaaagggaaaaataaaaatcaactaaaataacactttatttaatacctgtatttttttagacaattggaatttatatacctcctgacggaaataccaacaataccatatatgaagtggtcttgcaaaaaaaaaaaagataacaaaaaccaacatgtgatcatgaccctaaatcttattacgaactaaccgcaaatacaagagccaggggaccaccaagggattccacacagtggaaagtttcggaactggcttcttcaacacaaaaggagacgtaagacacacgctggtcagtcagactatggctttacttggataaaggaaacaaaccaactactaaaaaagaaaaacgataatcagagaaacaacagtaaaaggacaactgataatactaaaaaatgattctagtttctcagatgtgataacgatgtggttatgtttaataaaaaggaaaccctatcttttagagatgtatattgaaatatttacagggaaaataatacaatgtgtgaaatcttcctcaaagtactatgtggggcagagaccctgaggttcatcgttattcttccacctgagagaaggaagttcactatactattctgtctacctttgtacatttgaaattttctataataaaaggttaaaaaagtaaccatgccacagtctcagcacaacacagtgatcccgatttgaacactctgcatcctacctattaaaaaaagtaacctttacaccaatatatctcttaattactaatctgacagtttttcaaaaaaggcttataaagttttccaacagaagggattactgatagtcacctcatttaaacagttaataacgtatcattttaatgcttttttaacttacctaatgtgtgaatctaaaatgagatttaaagaatgatacaagtattgacagctgtttcaataaataacaaatattttgttactggttcaagagacctaaaatattttgagatttaaaatatatcaactattgcctcccggcatggcctaaaagcagatctctagattgtaaagggaaatattcaatgggagaaaagaatcctccagccaaagcaaagtacttccacacagccgaccaaggagttgaaggcgggctccgcactcgccagtgccttacaccactcgcaggccttactgaattggacaggaggattttatttaatgtctctttatgtaaaaagcagagaggataagtccaagtgttctcccttcctatctgtggcctctatgctagtaacacatttttaacctcatctgtcaaagctacagtctaaaaaagaagttttatcaaccttgttcaacacttgggagaccataactctcttaaatcagtttctaaaaatttcttttcatgtacaccagaaatgtttattgcatgattaaacagttattatggtctttctagacacacaagacaatcttaaaaatacaacaccatctcaaataaacaactatatgtcaggttggtgacataatgatttagagaaaaattatcgttaatttttttttttttgagatagagtatcgctctgttgcgcaggctggagtgcagtggcgcgatctcagctcactgcaagctccacctcccaggttcatgccattctcctgcctcagcctcccgagtagctgggactacaggcgccggccaccacacccagctaattttttgtattgttagtagagacggggtttcaccgtgttagccaggatggtctcgatctcctgaccttgtgatccacccacctcggcctcccaaagtgctgggattacaggcgtgagccaccgcgcccggcaaaattattgttaatttaaaggacagctatttacgcagaaaaccctacaaattcaccaagagaaatttttttttttttttttttttttttaaatacagagtcttgctctgtcacccaggctggagtgcaatggcacaatctcagctcactgcaacctctgcctcccgggctcaggcaattctcatgcctcagcctcctgaatagctgggattacaggtgtgcaacaccatacccttttttttcttttttttttcccagtagagacgggattttgtcatgttggtcaggctggtcttgaagtcctgacctcatgtgatccacccccctcggcctcccaaagtgctgggattacaggagtgagccactactgtgcctggccacaccaagaaatcttaaaatgtactcagtaggcttgttctttgaggtaaatgttggtattattattttgaagctattttattttacatattgtatatatacatgcctacacatattcacactgaacaggataaagttgataagaatttccttaatgttaggtacacagattttcaacataaaaggagatatgaatacaaaattaaagaagctaagtaaactccacgtggtcattttttaaaattggaagtgtaactttttaaactacagtacaggcttcctttgcaatacaccactattaccactgatatccttttcctattctgggctctgatcttggacctcatgctgtacttagctgtccttccgttgagtctcctttaaactgcagcagttcctcagtcttgccttattcatctacgcttttccagagcactagttaattactttgtagaatgttcctcaatttgagatgagcctgggacatcttaccatgaagcaggaagccatgaagacaactggtcccatcaggaagacacagaggccacagcaaactaagggagggattcccaatagccatgcacggagccacatcaggatcaggaagaatgaacggaaaacaagtcggcagcaatcatgagagctaccaccaccacagtgctcgccttgggactacaggacacccacttattattcccaagatcactaaaggacaacagttatttcaagctgctgttcctcgatgaactgcatttctgaataaccaaaaagctgatcagggcaagaaccacagtcaatggggagtgaatgacaggatcggaaaaatcaaaatatcccaatatctaatacaataataaagtcaataatcattgatgtctgctgaaattatcaagtgaagaacgtgatgggaggtttccaaatggttaagtgagacattgactgaagctatttttcagtattatcattaaaactgggcctctaggcattttatttttgacatgatcaaagactaccatccacaaagtagtcgtgccaaaaaaagagcctgtatttaatcatacctctagatcttactcccaatttaaagggaattctagggaaatacatgttaaatcacaccagcacaaagccatcatctaaatccaaaatgtaggcaagaaagacgacctcatttctatagcaaataaaagatatttaaaaggagagctatttttattgccacagaattaaaaagccttaaccaaaataatccaatgtgatgtaagaactgtgtttggatcctgagtcaaataaattaggtttaaaatgacatagaaaaacttttaaggttgcctaggtaataaagacagagaaaactttttgacatagaaaaacttttaaggttgcctaggtaataaagacatgataaaattactattaattttattgagttccaaccatagtattgttatatttattttaaaagatcttctttataacagctagaaactaaaagactcatgaataaagatatatgtctggaatttgctttagaatatgccaatttttttggtaagtttaagggaagagaagaaacaaaaatatatgaatggtggcaagctgatggtagctaaagctagatgactggtgaactgaggatcactatagtatcctctctacttctatgtgtttaaaactgtccacaataagccaggcacggtggctcacatctgtaatcccagcactttgggaggccaaggcgggcggactgcctgagctcaggagtttgcgaccagcctcgggcaacacagtgaaaccctgtctctactaaaatacaaaaaattagctgcgcatggcggcgtgtgcctgtagtcccagctactcgagaggctaaggcaggagaactgcctgaatccgggaggcagaggttgcagtgagccaagatcgcgccactccactccagcctgggcaacagagtgagactcagtctcaaaaaataaaataaaataacgtaaaataaaataaaataaaaaataaataaaattgtccacaataataagtaaaagaaaacctaacttggatatattatcagtacacacttaagacttcatatgcttatttctatttaaaatttgtattaatgaaataatactaaatgtgtaaacaaatttattaacaatgttcacagcagcttagaaaaaaaaaaatcccatggaaataaaaacgcagaaagtaggctcatgcctgtaatcccaacactttgggagacaaggtagggagatcacatgaagtcagttcaagtccaacctgcctaaccaggctggtgaaaccatgtgtctactaaaataaatacaaaaattcccagctactcgggaggctgaagcatgagaatcacttgaatccaggaggtggagattgcagtgagctgaaagcgcaccactatactccagcctgggcaacagagcaagagtccatctcaaaaaaaaaaaaaaagaaaagaaaagtagaaacgaatgcagtatgttacaattacttaaaatactcacaaaaactgcataaagatttaaaaaaaagacaaaactgtagatactaaagttgcaatatatttataaaaattcaaattttataagtacgtaaaaacaagaaactagaagaaaatatgccaaaagactaacaatgtgtgattaacttattgacttcatctcccagagtctcagttttttaaataacatattatttttattacacgtcttcataaaacatccagcttgctgattccatcagttgctgagtccaaggtcccctgccatctttcccacagaaagggcactgctgcccacgcaggagaagctgcccatgcaggagaagcatctaagtcactttgcagttgtttttcaatacagattaatcaagtgcaattcagtgagcaaattttcttgtgaaactacactgctcagtcctgttcactaagataatggttctcaatgtgtggtgtaggcatagtccagagtcccagaaacacttccagtggggccacaaagtcaaaccattctcaaaataatgcaaagatgttctttgcttttttcactcttattctctcctcacaaaaccacagtggagttttggtatagcatcaaagaatattcaatattcatttatatgaaatgactaccaaaataataaaataaattacctgaggccagatttccttcacacacttcaaccaaaataacacagtactaagagatgaaatgcaaaagcagacaagaatccagccaagattctattaagtcagacattaaagagatttacaaaacatgaaaaaacaatgccactcttcccactgaattattttttgttttggaaaatactactacctttcataaacaatgttatttatattacctaatgggtttgttattattaaaaatgtatatttataatattaattgattcttgatacttaacatagtaaatacagacagagataaaccacagatggagacaaaccatataataaactcaagcttttaggcatcttcagtaatgtttaacagcataaagacgtccttagaccaaaagcttgagaaccactccactaatacaaacccttaaaacccagttctcaaggacagatgcccatgttcatggatggaaagacatccatgtttatgaagaggaagacatcccatgtttacagatgggaagacatggtatttttacaatgccaacaaaccccaaattaagctacagattcaatataatccctatcaaaattcacttttgtgggagaattttttttttttttttttttggcagaaattgctgagctgatcctaaaattcctatggaaatgcaagggacccagaatagccaaagcaatcttgagaaagaataaaattgaaagacacacacacttcctaatttcaaatcttactacaaagctacagtaatcaagccagcatggtactggcatagaccagacaaacagatcaatacaatagaaacgagagtccagaaagaaaccgttacatttatagacaactgattttccacaaaggtgtcaagaccagttgaggggaaaagaacaatcttgtcaacaaatggtgctgggacaactaaatgtcaacatgaaaataatgaagctgggctcctacctcaacatacacaaaaattaaggcaaaatgaaccaaagaactaaatgtaaaagctaaaactatatgacttggaagaaaacagcagtaaatcttcataaacttgtattaggcaatggtttattaattatgacactaaaagtataaacaggaagaaaaaaatacactggatttcatcaaaacgaaaaacttttgcccctcaaagcacactatcaagaaagtgaaaagataacccaaagaatgcgaaaaaacatttgcaaatcatatatccaatacggaacatatatctagaatatataaacaattcctaaaacttataatgagacaaataacccaacttaaaaattggcaaatgagagcccagcgcagtggctcacatctgtaatcccagcactttccgaggccgaagcaggcagattatttgaggtcaggagttcgagaccagcctggccaacatggtgagaccctgtctctacttaaaatgcaaaagttaggcaggcatggtagtgggcgcctataatctcagttacttgggaggctgaggcaagagaatcacttgaacctgggaggcggaggttgcagtgagccaagatcacgccactgcactccagcctgggcgacaaagcgaggctccatctcaaaaaaaaaaaaaaaaaaaaaaaaaaatggcaaatgatccgaacgaacattttcccaaagaagatatacaaatggccaccaagcacatgaaaagatcgtccacatcattcgtcatgagggaaatacaaatcaaaacacaaaataccactttgaaatgaaattaaataaaatgaagtaaatacagaaaattaaaacaaaaatactactttgcatccacttggatgactattatcagaaagataggtaatatcaagtgtggctagtacatacagaaactacaatcttcacacactgctggtacaaatgtaaaacagagcagccattataggaagcagtctggcagtttctcaatatgttaaacaccgagttaccatatgatctagtcattctactcctagggatatatcccagataactgaaaacatgtatctgcctgaaaacctgtatgtgaattttcaaagcaacattattcgtaatagccaagaagtagaaacaacccaaataataaactactaggttaagaccctcccttttttatgtgtgtctggcataactcattggattttcaaataatagcaaaaatcataatttcagaacttgataatttctaagaaaatcaaaataaagaggcatttcctaaacagcaggtaattcttttctggtacgaaagggtaatgtgaaaacacaaattatttgtctctgaatcagaaacctggaaagaaaaagaatgagtttggtaaggattattctaagtgctttctccacgttaccaaataaacttaattctgttaattaggttccatgcctatttagcacagcaggaaattaagatcagggataatttaaggtcacaaagctactaagttcagtgaggctatattaatgcacatataattttgctattcaactatatgtgcctggagatcatttaacaggcaattcactctatcaatccctgcatgtgggtgaatgtcacatcgtaacatgacctcagagaagtgcacctacagtttccttagctcgtcttcattccttcttcccttttacagtaatattcactgcaccaatgtacagatcatgattttagcatgtaaagataagcatcttttttcttacaatatggtacttaaatataagctaaatatttctctttttatacaacaaaaacagtgatttgattcaatgccagactaaaactggtattggatcaattgtatcagtgataatattaaatacattgtaccttacacggggatcttcaagtatattgatgatttttgcattatgggttgaccttagaacagacatttcccatgagagtgtgctgtatgggagccaaatataaaacctctctcctgaatctaaaaacattattctgaagtcaggaactccctactcacaacagattactccctgttctatttgccatgttctgcacattctattgccttttcctggaacacaggtatccctgtgttttatcttctatctacacacagtgatactgagaacaggacagaaatacatatcccaccaatgatatattacaacttaccttgatcttcttccttttgttagtaacattcaaatatatgcagttttactacagtgttgtctaagtactccatttctttatttgtaaagtttgctaagttaccttctaactctaattgtctatgattaggaacaatgagttaagggatgacgcatgaacagagatggacagcacaagatgctcctagacagacatgtgttccaagaactccaacataattttattttacagaccattttacaaaaatcagtaaatgaatattcaactagataagtaaacagaaatttacctaaataaggaaaaagggctaagaactttagagattgccttaattaagtactatataatctccttgggaatcaattagaaaaaatcaaaatgtgttactttcaatgtccaaacaaaatttgtagaaaacagtttaccacccagactttgatccctttgaagctacataaattgatcagaaaaaaaaaaaaatgatcacagaagctaaatcaaatcatcagaagcacaatcatggccaggcacagtggctcacgcctataatcccaccactttgggaggccgaggcgggtggatcatctgaggtcaggagtttgagacaagcctggccaacatgatgaaaccccgtctctcctaaaaaatacaaaacttagccaggaatggtggcatgcgcctgtaatctcagctactggggaggctgaggcaggagaattgcttgaacctgggagaagaaggttgcagtgagccaagatcgcaccattgcactccagcctggcaacaagaacaaaactccatctcaaaaaataaaaataaaaaaatgataataataaaaagcacagtcatagcattctaggatcggaaagaaggatgtctttttttttttttttttttttttttttttttttgaggtagggtctcactttttcacccatgctggagtgcagtggcccgatctcaattcattgcagcctcgaccttctgggtccaagtgatcctcctgcttcagctccccaggtagctggaactacaggagcatgccacaaagcccagctaaaaaaggatatatttcctttttttttttttttttgtgagaagcagtctcactctgttgcccaggctggagtgcagtggcacaatctcagctcactgtaacccctgcctcccgagttcaagcgattctcctgcctcagcctctcgagtagctgggactacaggtgcacgccaccacgcttggctaatttttgtatgtttagagagacgatgtttcaccacactggccaggctggtctcgaactcctgacctcatgatctgcctgcctcagcctcccaaagtgctgggattacaggtgtgagccaccagcgcctggcctctttttttttttttttttgagacggagtcttgctctttttgcccaggctggagtgcaatggcacaatctcggctaactgcaacctctgcctcctgggttcaagcgattctcctgcttcagcctcatgagtagctgggattacaggcacctgccaccacgcccggctaattttttgtattgttagtagagacgaggtttcaccatgttggcctggtttcgaactcctgacctcctgatccacccgcctcggcctcccaaagtgctgggattacaggagtgagccaccgcacccagcagaaggatatatttcttaacagaaattttcattatgattcccacgtgcatatctaaatagagaagtgcagaaaataaaatacaataggaattctagttcctcatccatctgccttgtgctgttagttggatgatatggtttatctcacggctgccagcaccactctgtaatatttgaaatgcacatttttatcttacaatagaataatgtgagagcaccttagggcagattattttatgttccttccatgtaccttatacacatcatatactcaagtgaatctgtaagcttgaatagtgggaacatttacagagcaacagactgctgcttccaacaaaactgttattttagtcttttgtttttttcaagattcagtatctctatgatattccattcttttcgtttcatgttcttatagtaagtgtgtcactcaaagatactgacggataaaagaaatgcgtccaatctcagtagagtagttgtttatacatttaaactggcactcagcactggagtattcctaaggagatgttgccaataaatttcaagactaattttgtaaaatgtcctttatatgtgtacatcggtgcttctactgaaaaaaacagcagtgagaaaatgtgagttttatttatagtttgagttggttctcctcctaaggaggacataatcagacacaagatacaaaaacttatttgttagcaagatctgattgaaaaagtacctacatgagaagaccaccaaataatatactttcaaaatcttcctgattttaaatttagaacgtgtctactaagtcgacacacaaaaaaaggacaacggtcccctccaccgttaaagcctgtgactgggtctacgacattatcttctggagagtacaatcttttgaaaagaccattttagctaggattcttactaaaacataatacaaaacaaccaccgaaactggagtttagatcatctcattaaccctctggctaggagagcattttactcattaaacctttgacgaactcaaaaaccaccactctaatacttggttgtaaagaagctgaaataaagtatctgaaccaaatgcacagaacattgttttgcacaagccctaagctgcagcagtgcgaatcatggccctcggagtaccacttcttgcttttatcccgtgctacacctttcccagtaaagagcttcttaggaagggtttccacaccttttcacacactttcacaaagggaaaagcaaatggaaaagttgacaactacattaggagtatctttttaggacacaagcttagctaattcacacagcttcctttgtcaaatactggactaccaagaagcatcaaaaccaaaatctgcagtctaagcagggcacagctgcagcacgttcacttcatttaacctcaagttgaagcagaaacataaaatcttttttttttttttttttaattttgagatagagtctcactctgttgcccaggctggagcgcaatggtgccatctcagctcactgcaacctccacatcccaggttcaagtgattctcctgcctcagtctcccaagtacctaggattgcaggtgtgcaccaccacactcagctagtttttgtatttttagtagagacagggtttcaccatattggccaggctggtctcaacctgacctcaagtgatcccgcccacctcggcctcgaaaagtgctgggattaccggtgtgagccacggtgcctggcataaaatctttttaatacagatgttaaattacctggttgaaaagctagttgtctcttttgtctagtctgtttagaatatattctaacctccatttttctgtccatcagcattttattccattagaaattacttctcatgttgagaatgtcaacctggacaaacaagattcaacctaacctggcaggatgtgtgctggatgcccaggaagcctctcctgacttgcaagcgtcccctacttccactcttccacatccttcagacccacctgctcactgctgcactcaggctcacttatgccatctctcagccatggactgatctcgcagatggcaaacaaagtatacccagagtccagaggaggaaaaggcaacttcctgttgatgtttcacatgcaatcttaccttttggacaaagagcagaactgcctgattcaatcttttataatttacttttaccttaaggaattgcatatataaacttatcttactgcacggctttaattccattttgaatatgtattttcttgagattattgatagtctccataaaaatctttgcttcctctcatttacatctgaaaacaaaacaaaacaaaaatgctgatggacaaacgtagtagcatgggcatacacctgaactgaggaaaagccagaattggcagcacagcacacagggccttcctcgtcaggaatgcaccttgtagagtacaccgcttcactctgatgggtggaaaaggtctctctccacctcatttccagtggatcctgcatttcttcaaggaatacagatcatgttctattgagctttccaattcatcatcacaaaactacagttttcaattgaaaatacataatactcaaagagtaagatggggaagtggtgagtaaactcattttttagaatggcaaaatgtcagagctgggaagcagctcggagctgctttaatcctgtgcggctcaaatgggaaggcatatttgtccctaacaatgagtcagagaaccatgaaatgatacataaattgattttgttaaaaaaaaaccttgacacgcaacactgacagaatacaagctgagcagcactaatctgaaaatctgaaatctgaaatcctccaaaatctaaaactttttgagcaccaacatgacatcacaagtgaaaaattctgatgtttcttctcacctacgaaaattaaacacaatccaagcacaatgatgcatacctgcagtcctagctacttaggaagctgaggctaaaggattacttgagctcaggagttcaaaaccaatatgggcagcatagcgacactctgtcccctaaaagataaataaaataggccgggtgcagtggctcacacctgtaatcccagcactttgggaggccaagaaagggagatcacttgagctcaggagtttgagaccagcctgggcaacacagtgaaaccctgtctctataaaaaatacaaaaattagtcaagtgtggtgacatgtgcctgtagtcccaggaacttgggaggctaaattaagaggctcacttgagcctggggggcggagggttgggggggcattaagccgagatcatgccactgcactccagcctgggcaacagaggaagactgtctcaaaataaaaataaaaataaaaataaaataaaaataaataaataaaatgaaataaaataaaaatacataaaacacagtgtacagtgaccttttaatcacaacacagcatcataggtggacactgaaaagtctgctgctgctgttatctgacggctgatccaggtactgtggcgatgtcactgggctggttagttacccgagcacatcatttcctcactgtattaatgctatgtcatgttctttactgctgagtactcccatgcgagcaagggtaagaagatgactgccacttggtagcatataaatccagaaccaggcacgatggtggcattaagcaaccagactgtccacatgggtggctgggatggtgacatctttgctttctgatggttcaatgtacagacctcatttcacgctaaatttatttaaaacattgtataaaagtaccttcaggctatgtgtataaggtgtatacaaaacaattctgtgtttagactcggatcccatccccaagatacctcattatgtatatgcaaatatcccaaactccaaaaataactgaaatataaaacacttctggcctcaagcatttcaaataagggatactcaatctatagttataaaaatgtcttcctcaagttattaatacagccctggaggcactccctaaagtcttattatctgaacctgcaaattaccttccttaataattaaatgccatttaacagtgttataagtggtgataaaatacaccttattttacacatgcattaatgtgaagtcctcctttcttgaatttaatattcctaatatatacgtatttcttagcatttcagtgaaagggaaatattccataacaattataatcctatatagctcttgaaaatcacacctcagaagtcaagacaaggaatctaaatagagcagacataaaacacttgaccgaagtcaggatcctatcttcattagtccctccatgcccagtctagatcccatttactcctgtctttgcaattatgtttttttccattatgttcaatccttccctgtcactgtttcaacagcttattctgtcgcaaaaaaaagaaagtgaacgtggggaggggaggagctgaggagcaagggaggagctgaggagcaagggaggagctgaggagcagggaaggagggcagaatcagcaggactggacgtcctcctggcctcctgctgaagaggcagctctcaactgtttctatctccaacctcccagaaaactttccttctacaagaaccagcctcctgcttgctggtggacagggaggacctctcacagcacagtggaacagaccagcctttcccttgaagcccactctaccctcttccacttcgtcacctgctttctcagcctcttgggaatgctcttctgcactaagtagggcaaaagctctcttgccctgtgcaatcaaaagaaatagtaaatcaaatgggcaatcataaagatgaatacataaatctttagctattttatacatcttcattcacacgggcctttttctgagacttggtcaattagatattatttctttcccacataaactatatccataatgcatcaacaaagatcttcattgttttttaaagtgcagctgagagacaggaaaaccctctgaatagtacaatgcttctatgactcttcttcagtttttatccttattttcatatctaattcatcagcagtttctctgtgatttgtttttgagatactccaaagttttcaaatgagtaactgcttttacactattttgatcaatttatattaattaaatcacacagctgcacgaatgagtatgatcgatgaacaagtttggaagctgacctggctttggtaagcacacaactccactggtgggaagagggaacagccctgctgaagagaagcccagcgccagtgtggtgcaacccacaggtatgcatggatccacagacagcgttgatcctggtgacaggccacggtatgtgtgcaaaggagtctacctccttgtctccttgagttatgctcctgtgctcccagtttctcatggcttctgttcacaaccatatgctcagtttcagcacaaaattatctaagtgaatgcccagtgaacaccttatgatcctgcagagttctcaaaatcaattccctacttctcatttaaaacaaatacgaactgataaccaatctctcttattgaaggacatatcattgactcaggtgcccaaggcagaaacttgcaaatacagctttaacttctgctcaagtttctatccctgtcatgaaactgtgcagaaaaccaccaactgaactgaattaccacccagtttcttaaagcatctcccttcttcccacctccccaaactccacagattcttccagactgccctccctaaagcgagggactcgcaactgaaaccttctgacaggctgcaccaggataaagtgaaaagaaccacagctactgagatgctctccccatcctcccacaaagccttggttggttattctatgtactcctgcaaacctttacacccaggaatacagcatatcaaattatcatcctcactccaacacaaaagttttatcactcggaggtcagaaatatgtctaccctgttcactgttgtatccctaacacagtacctaaacgagtaaaatctcagtaaatacattaataatttattatcttgtggcaacaaatgtgggaaaaattaactagcatttaaaatatgaagcccagaaaatgggatgagtccaaagaacggcctctgctggtgcacattccaagtggtgtaataagggaaaaggcaatattcacagctgagggcaaaattactttgagttaattttcattttcattttattttattctctagactttgtatatgcatacatgcatgtccgtttaagtgtgcacctgggatctaaacatacaaaggagttaaatacaaagtgatgactaaaaatttttattgtattatcaaaacaaatcactaaagaagttccgaagtggcaaacacatactgaaacaattatttgtattgggggatgtgagatcgtgaaatatatatatttggttttcctcccatttcatggcatagaattcttaaaatccctggaatctcccaagtaataaatgtctttttgtatactaatgatatgactgggctggcagtcctaaggtgttttcaggatgggaactagtcaccagaaagaccgaggcagaattagactgttgggactttcagcccactcccaatctccaggtaggggaaagtggcagaaggttgatcatcaatggccaatgatttcagcaatcatgcctatgtaacggagtttccacaaaaaccctaggctgggtgcggtggctcacgcctgtaatcctagcactttgggaggccgaggcaggtgcatcacctgaggttaggagttcaagaccagcctggccaacatggtgaaaccccatctctactaaaaatacaaaaattagctgggcctggtggcgggcacctgtaatcccagctacttgggaggctgaggcaggagaaatcacttgaacacgtgaggtggaggttgcagtgagcctgagccaagatcatgccactgcactccagcctgggtgacagagcaagactccgacccaacaacaacagaaaaaggactcggtttggggagcttccagatagctgaacacatggaggttgttaaagagtggcagcccaaagagggcatgggagccccttgcccttcccccacaccttgccccacacatctcgtcatctgcatcctttgtaatatccttcaaaataaaccaggaaacatgttttccttacttgtgtgagtctgtcaagcaaagtaatggaacccaaagagggggccatggggatcctaggaagcatgggtaaacaacctgtggcgtgggagtggcatcagaaggggcagtcttgtagggatgagccctcattctgtgggacctgacactatctccaggtagagtgttgagactgaaggggagggtgccccactggtgtctgctgtaaaactgattggttgctggtggggagaaatccccgcacatttcttggtgaccagcggtcacagaattcttctgggttgattgttgtgacgcgaaagcaggagaaaaaccgctttttcttcaggagggaaaggtcaaaaaatcctttccaaaatatactgaaagctatgaaacagaattcagaagttccaggactcctccaagttcatctacaaacaagaaaaggaaacgtcaaggagtgcaggctgcagcacggggggggcctcccttgccaggtggtgaggggccgacccacctctcctcctttgggggacacctgaaacagatagcacaatgcctggcacacagcatgtgttacacaccacagccaaacggcaggcgtgggagctatgaaattccaagttgcggccaggcgcggtggctcatgcctgtaatcccagcactttgggaggctgaggcgggcagatcacaaggtcaggagatcaagatcatcctggctaacacggtgaaaccccgtctctactaacaatacaaaaaattagccgggcatggtggtgggcacttgtagtcccagctactcgggaggctgaggcaggagaatggcgtgaacccgggaggtggagcttgcggtgagccgagatcgcgccactgcaatccagcctgggcgacagagcacgactccgtctcaaaaaaaaaaaaaaaaaaaggaaattccaagttgctcagagagtcaatgtcactgactccaagcacagaatccaacaacaatcttcaaatattaggcattacacctgcagaccagaattgtttcccagaaacaatgcaaactgtttaatattaaaatatagtgaatgtcccctaaaattgttacttacaaaagtactttttacaaaagagaccgggctctgtggctcatgcctgtaatcctggcactttggggggccaaggcaggtggatcacctgagggcacgagtttgagaccagcctggccaacatggtgaaacctcgtctctactaaaagtacaaaaatttggcaggcatggtggcaggagcctgtaatcccagctactcgggaggctgaggctggaaaatcacttcaacctgggaagcggaggttgcagtgagctgagatcgcgccactgcactccagcctgggtaacaagaataaaactccatctctaaaaaaaaaaagaatttaagttccaagattttttttttaatcttactttggtttactattccaaatgacaattacctaagacatagcagtaccatctccatcctataaacaaattggattacaattacaggccagttatggttatatgcctacttcaatagacaatgtgactgagaaaagaaaaacagcttagtgcagttgagctatgtgaggtatgcaggcccagagagccgtgagtgtgggacttctgtcatgcctcccgccccagatccatgctgagcagaattgtttagtcattttgttcctgactggctgccttacccttatcttcatgttcctgaaatctatgacaacgatgaacaatgtacagccaatcaatagcttatgttattttgatgtacattttttgtaaacaactcaggaactgccttttttccctttaaaaatctacttccaacttctgctaatggggtgtatactcagagcaacctgaatccatacacctgggctgcaatcctcaggcttggcccaaatcaactctctacttatattaattttgcctcagcttcttccttttaggctgacatacgtgatgtaagacagcaggattcagaatgtctcccctcaatcacctggtttttctgagagtggcgctgggaaccagtgtgacactctccatcttcagaggtctcatgtggtgttttgtgtgaggtctcctgaaattggaactcccattctttggctgaacatctagattttacttggactgtttttcaaactccctctttcctttaagagtgagggctttgctgtctttggacaagagactggggtgaagagttccgcagacaactgccttctttctgcctctgcctcagggccaggattttgggtcaaggtttttccacctctgctcatggcagaggtttgggataaaggactggcagatactggtggttacgttttatagagcatgcttttaagattgcagctgttttctatcatttgaaaatctgggcttagcctttcatttgtgaccaactcctgttagtttcctactgaaaagcacacagcccttttgctcctccagatgggtgtgagggtctggtcccccgtaccctgcttgagcactcccgtcccctggcagttagggacagtccaagtcacatcacacttagaccctaaacacattcccagccatttgtcacttttcagaagttagtaaattatacaaaattggactttacaatctgagcagtctttgtggaaacatcagctggatgtgtgtgcacttagggggcactctcttacatttagaaagtggagccgcctaacacaggacagttgtgagcagcagtagccaaaatgagcatcctttaagtgtctaaaataattaatctgtgtacctaattgggggaaaagttggctttagaaccagagaaactaaatgggaaacgtactttatgtttgtgctgaaatctgatgataagatttgaaaacattctttttcagagttctacggtcagaagtataaaaagctgatactttggctattgtttttttggaaggaaaaaaaaagcctttctgctttttcctcttttggatcctgtttctgggaactcttttcagtcaactgaaactcaccttaaaatgtgtttgatccctgtttgcttcctgtcttgttggtatgatttttgtggaggaaaatacaaaacttaatttgcctgtcagaaagcttaagatcttcctaaaatggttcctctgagacttgttctgtttccttccacacttctactccttctttttgccatatttgatacatgaagaaatctagaggacacttctaatgactctgagacccgcttcggaacacaggaagaggcaacactcacccccttctggaagggtcttctgttttcagtacggagtctgaagagttgtgagtagtttcctctcaggtctaaagctctgctcccttttgcattgcgctgtccaatttcgtggttttcgggggctttcgggattactttacactgtgagagagaccctgacttttgtgtgtgcaatggcggacaagtcactggtgaaagctgcagtttgggaagtggctgactgaatagttgttactgcaggatggctactgtttctttacacatttagacagatgcagtttgaacacttggaggttaggagagtgctcaccaccaagtgataagattcccatatgggatgggctggtcacagtgggctgactgggccactcaccaaccttgagggaatgtccttgcagtgagaagcactgtggaagctctgcgtggcaggtgttatggcgtttccctcctttgggggacccaagattcagtctattaataaaagtggaatccttgatttttaaagatgtagatcaagggtgtccaatctttggcttccctgggccacactgatcttgggccacacataaaatacactaacactaatgacagctgatgagatgcttaaaaaagagagagagaaaagaaaagaaaaaaaaatcgcaaaaaaaaaaaatcttcatactgttttaagaacatttacaaatttgtgttgggccgcattcaaagccatcccaggccgagggtaggacaggcttgatctagatgctctgcctttcatctgtgcctgcttttcaaatttaagtattaggccctagaaactgcaaatgttttctttttccactcattaaagtcagtaatctaaccaagaaacatctaggttggaagaccacctatctaaccagactgctctccaatatatgacgttctatggccgagcgcattggctcacacctgtaatctcagcactttgggaggctgaggcgggcagatcccttgagctcaagaggtcaaaaccagcctgggcaacatggagaaacctcgtcttgacaaaaaaaaaaaaaaaaaattcaaaaaaaaaaattagcggggcatggtggcgtgcgcctgtggtcccagctactcgggaggcatcacttgagcctgggaggcagaggttgcagaggtcactgcactccaacctgaatggcagtgagaccccatcaaaaacaaaaacacaaaatatgactttctgacatttagctagctatcctgaacctctttataaaagaaactgacatctgtaagggcatctcccttcctgcactcaagccactataaacttttacaatgaaaaaaacattggcttaaagtttacagagcaaaccttccctttgcttgatgcttttcctggcaattcctgactatccctttttgattcaacaaataatagtgtttagatctaagttctctgcctttgggatgtaagttttcacctgagagtcatgtctttggaagtgaaaatttagggttgtctagcaatctgaattgtttaggggagtggaacagataattaagagactgatagtctaaaggagggggggaattattttcactagcaaatgaaaaatcttataaaactgtaagatctgcttctgttagtgcatctgcatgtctttacttttatgtatcatatatatgtgatatttcactaccaaaatatatgaaacacctctaattaaccagcttaaagaaaacacaagtgcttaaatcaaatatttcatcagacaaatagaaactcaaatgtcttttagttcatgacttgggtagatctttggtaaataaagattagtttgttggtttaatgaaaggagctatgtcttctcatcagcaaatactcattcatttaactctagggtttcacaggctgtagaaatgattaacaaagaaataaattgagatgatggctaactttgtttaatgaactattcaagcataataactgttaagaatgaataaattagggccgggtgcagtggctcacgcctgtaatcccatcactaggagttcgagaccagccaggccaatacagtgaaaccccctctctaccaaaaatacaaaaattagctgagcatggcagcgcacgcctgtagtcccagctacttgggacgctgaggtgggagtatcacttaaacccaggaggctgacgttgcagtgagttgagatcaagccactgcactccagcctgggtgacacagtaaggctgggtctcaaaaaaaaataaaaataacgaagaataaattagatgaatgtaaataagatatttataaacaaacttttcatagtttcacaaacccttttcaaaaatttaatcttaaagccatgttatgttaattaacaggtaatcataaaatatctatctcatttatagggtacagaaaagttaaatatatttaggttataaacaaaatatatttaggttataaacaaaaattgaggaaatattcagaaattgttgtcatgtggtataaaacagttcaaaattacttcctgggtttttcactggaaattcgagttactaagagttaaaattgtagttaatatacgtaattaaaactattaggtataagaaacaattttatatacagagcatattttaaaagatgtaaggaaagttgaaaagagactaattgtttttcccttgtacacagagatctttgtatggtcaaaatgataagggggaaaggaaagtaagtttttctcttaaggtaaaatgccaatataaaaaagaaaggtaggttgcagtgagccgagatcacgccactgcactccagcctgggctacagaggaagactcagccaaaaaaaaaaaaaagtcgagtgaggcgtggtggctcgcacccgtaatcccagcactttgggaggccaaggtgggtggatcatgaggtcaggagttcaagaccaacctgaccaacatggtgaaaccccatctctactaaaaacacaaaaattagctgggcatggtggcgcatgcctgtaatcccagccactcgagaggctgaggcaagagaattgcttgaaccgagacccgggaggcggacgttgcagtgagccgagatcatgccactgcactccagcctgtgctacagaggtagactcagcgccccacccgcccccaccgcccaccccccagcaaagaaaaaaaaaaaaaagaggtataggtcaaaaccaaaggcttcagcaagttgtagaccatttgtggaagattaatcttgtgaaaaaaaaattgtgtgtaatcaagcttgctaaattagaagagaattatttagttttgctaaaattgaacattaatatacaacgtacacaaatgcagggccagagtctgggcccctgtgtcagaacagcagacttttcttggagcactggtctgctctttaagaaaaaattttaagtggttgtaaaaagtttatggaaattttatcttgcatggtccaagctgattgagatttgatggacagtttcattaaaatagctttatactcaggaggctgaggtgggaggatcacttgagcccaggagtttgaggctgcagcgagctatgattacaccactacactccaccccaggcaacagagcagaccctgtctccaggggaaaaaaaaataaaaggctctagcactgacaatatactgatgcaaaggtaaaatttatttttctcttttgaacaagatgttcatataatattaatgaggataacaaaagacttttgctcaccttttgaataagctggaaaaaaaaagattctgttggtctcatgtcgtctttttaggtcttttgattgtttagaaaactgagtatcaaaaaagagaaaaagtttttgtttttttggccgggtgcagtggctcacacctgtaatcccaacactttgggaggccaaggtgggtggatcacgaggtcaggagatcgagaccatcctggctaacacggtgaaaccccatctctactaaaaatacaaacaattagctggatgtggtggtgggcgcctgtagtcccagctactcaggaggctgaggcaagagaatagcgactcaggaggctgaggcaggagaatggcgtgaacccaggaggcggaggttgcagtgagcccagatggcgccactgcattccagcctgggagacagagcgagactccgcctcaaaaaaaaaaaaaaaaaaggtttttgctttttgaaatatttcaattatctggctaaatgactattattttacagcaacctgtgattctgttttgaacaacatccttttcaatatttgacacatttcccaaaatcaactttcaaattctaaaattaagtcttttccaaaaggaaccccctggaagtccgagagagacctattaggcttaattggtatgttaaaattgtatgtgaagctttgtcaaataagaaatggtgtttaactttgggttatatttgtgtgcatggtattaatgtgtgttccaacgttacatgagatttctgaaatcctgatatgtcttgatatgtcagacataattatggttattatgttaaattgttgtatgccacaaaaataaccaaatttccttgtaaattgtgtctttaactgtagctactctaagtcttttggcatccacagacaattattgttctactttgactcttctcaaaaagtagtttacacttggctacagtcaaaaatttgctttttcttcaagggaattcatggaaaataattttttttttaagagacaaggtcttggctgggcgcgatggctcatgcctgtaatcccatcactttgggaggccaaggcaggcagatcacctgaggtcaggagttcgagaccagcctgaccaacacggagaaaccccatctctactaaaaatacaaaactagccaggcgtggtggcgcatgcctgtaatcccagatacttgggaggccgtggcaggagaatcacttgaatctgtgaggtggaggttgcagtgagccgagatcacgccattgcactccagcctgggcaacaagagtgaaactccgtctcaaaacaaacaaataaataaagagacaaggtcttgctctgttgtgcagattagagtgcagtggcactttctaactcactacaacctcaaactcctggacctaagtgatcctcccacctcagcctcccaagtagctacaactataagcacacaccaccacacctggctaatttttctattttttgtcgagatgggggtcttgctatgttggccaggctggtcttgaactcatggcctcaagcgatcctcccttcttggcctcctaaagtgctgagattatagctatgagccactgcgccaggtggtaagtactcttgaatacaagtttctgataattttgaagaccattatcattggagtaagtaaaaactttcagaactctaataaactgttgtgttcatgatgattgctaactctgtatatcaagcagaataaaacttaattacatgggactgaaattacagatgactgaaatgattttgacgactttttgtttgaaacattgctgattcttttcatgttttgttttcccaagtcgaggaagcttttttctttcaagctttttatagcttgtagcaaatgggtaaaacataactttatgagcaagactgaaacattcaccttactctctaccttatttctccaaaatgtataaactattcatgagtactcttattttatgacagtctaattatatgcgttttaagttcaataaaaaccggtttattgtaacaggacacaattaagacactggttattctaccgacactcttgactggaatggcgtattttaagatatgaccagactggtttaaagaacagaggttgactatgtagagccaataaaaagcctgttggaaagactagcctggtaccttgtttacatggctcctttacaaggttcctgatgtgcagcaagtaaaacaatcttactttctgacaagcccaggaacctcaagatattttgcgacctcaagaagagaggaattcacccaattcatgtaagtattaccagcatagtccttggcttggcttcctagccttgaggctttatagttgaatccaaaattccttatgaaagttccagcaaagacaacttaaagaacctatatggccaatcattattcttgttgcattttatgcaaataatcagcccaagtataatactaaaacttattttgcaagtaagctggtcctcctaagatttatatcttcagtaaaaatggggactggagagagaaaaaattatgcttcataagaaaactatagtacccatgttattagattccagccttaaccattgtgtttgagtttttattgttttcctacaatttggattgaatctccaatgtaataggatttttactatgtattttattgttttacctctaagaaaaccaaaagcatgaaattcaaagactacagaagatttaacaagcaatgacagttacataaatcagtgacttgactgagggctgagaatgagccttcccagcaccgtcatacatcatcccatcataaaaatccacttgtaactgccgctgagcaacttggtctatgctcctgggttgcaatcatcatgcttggcccaaataaactcttcactcagcttcttcattttaggtcaacactaacatcacaaaaagagtttcagacaggccggggatgatggcacatgcctgtaatcccagtgcttttgaaggccaaggcaggaggattgcttgagcccaggagtttgagaccagcctgtgcaacaagatgaaaacccatctctacaaaaaaatacaaaaattaaccaggtgtggtggcacgtgcctgtagtcccagctactcgggaggctgaggagggaggaccgcttgagactgggaggtcaagaccacaataagccaagatcacgccactgcactccagcctggcaacagagtgagaccctgtctcaaaaaaaaaaaaaaaaaaaaaaaagtttcaggcaaactataagaatcagccattgaaaattcctatcacttccaatgattctgaattactgttcggaaatgtagataactttactcaatcttgtagcataggatatctctggcttcaaagataaccacaatgggccaggtgcggtggctcacgcctgtaatcccagcactttgggaggccgaggtgggtggatcacgaggtcaggagatcgcaaccatcctggctaacacggtgaaaccccatctctaataaaaaaaaatacaaaaaaattagctgggcgtggtggcgggcgcctgtagtcccagctactagggaggctgaggcaggagaatggcgtgaacccgagaggcggagtttgcagtgagcggagatcaagccactgcactccagcctgggcaactgagtgagactccgtctcaaaaaaaagataaccacaatgaaaattactattaatactttgtttaacagtaattattcaactattaaatatttaaataattaagttattaaactattaagtacagggcctgtatctctgatgctgaactatgatgtgtgacttaagcccccaaatacatcatgttatttggatccaaggtgctgcacagaacgctgaccctctctaagagctgggtattacttgcaaaaggcttataagcatcggtgcatgggtcgttcagtggtagaattctctcctgccacgcaaaaggcttataagcaagaagctataaagttcccattttctgttcttcctgtattggatgatgtaaagcaaactgtcaccaagactcagtttcccaaacagtaaaacaagtgttctgaagaataaatggggggaaaaaagggagggggctttcaatcctctgaattacaagtccaatacattgttgagggtgggagttgttgcaatttgctgtagtttcttaagagtgtaagatagtgtgaaagatcctgacacacaccacagttgcctgaggacagtaaaccaaaggccaggagagctcacagcaagtcacattatctctagtgtgagttcctctacacaaaggtgacgggtatgaacacaggtgttgaagttggatccaagactgcacacagactcctgtgttaacagcgtggacgttaaaatgaacaactctccctgaatgctttaggaagaaaaccatttaatttacatgaatttctcttagactatttctcaaagatgaactgtaagctgcagtctgattacacgatacaaaccggagggtgttaaccagaacaccaattagcacctccctatttggattaaggttaatggattatctaaaatgacaaaacacttaattttcctggagtaaatatatttcaatcttttaaaaagcacagtctaataactgctttaaaaatctacctcaaaaagttaaaacacttatttaaattatctaacatacataaaattaatgctttcaccaatttcttttgatataccacagcggagggtgcgccttaacagcgaccacagtaaactctgcaattacagtgcaacgggatgctggacttaaagaggaggctcgttacagtcctagctctgtcaccaactagccagctgtatctctaattaattttacctcatgggcttcagtttctgagtcttcagagatctaaaatcctaagactgcaactgcaatattacactgtttttctgacaattattttcacaaactagttaccaaatctcagttgacaaaataacgtagaacaaaactcacagtcttagaatataaacatcttacttcaaaagtactatttaattcacacctaacattttatgaattaagaattaatcaggccagacacagtggctcaggcctgtaatcccagcactttgggaggccaaggcaggcagatcacttgaggccaggagttgcagaccagcctggccaatatggagaaaccctgtctctactaaaactataaaaataagctgggcatggtgacgtgcctgtagtcctggctactctggaggttgaagcacgagaatcacttgaacccaggaggtgatgattgcagtgagccaagatacagccactgcacttcagcctgggggacaaagtgagactctgtctcaaaaaaaaggaattaaaaagaattaaaggttccttcagtcttttaattccagactgataacgatggaactgataaaaagaaaacactccatgcaactgggttaaggctgattaaatgttatgttcactattattattattaaacatttcgtaaatatatgctttacaataaatttacctaaccacacttcccaacatcaaattgaaaactggaagttaagggtcaggcatggtggctcacacctgtaatcccagcactttgggaggccaaggcaggcggatcacctgaggtggggagttcgagagcagcctgaccaacatggagaaaccctgtctctactaaaaatacaaaactagccaggcgtggtggtgcatgcctgtaatcccagctactcaggaggctggggcaggagaatcgcttgaacccaggaggtggaggttgcagtgagccgagatcgcaccattgcactccagcctgggcaacaagagtgaaactccatctcaaaaaaaaaaagaaaaagaaagaaagaaaactggaagttaatgatccagcatttatttgccttgctcatataattatctaacacaatttgtggccatataacgattttgggaaaacatctagtctacagttatttatgttgagctgtaacttcatgtgatttcatgaaaaacctattctcaataacagaataaaactaccacttctttctttcctgtaaggttggcagggggacgcggggagggggaggactaccacaatgaccaacacacttccaaaattctgaacttacaggaaatagtatgccaagaatctgtgtggccttgcctgaaagataataaaacttgtggtcactcggaatcctaaggcacactgcaaaagtttactcttcactggaatttctccaggtcatggagatttttaagtgcctcaatgcttctacagtttatttggcaattctacatcccatttccagtcctttcatgcttaggtttaactctcctgtactgagccctaaagaataatgatttcagcagaagagattaaattcatcggtgtgtacaaagaaatgggaagagcagggaaaaactgaaggccacgtgcacacgcagcaacactggtaatactgcttcccatattcattctttggtcttcactgacagcgtgaagaagcaactattgctgattcatcagttactcattttcacaatggtcagtactccaagtcagcggtaaccaatcttttttggcaccagggactgacaggtttcatgcaagacaatttttccacagacagagcggaggggtcagggggtggggggtggtgaggaggatgctttcaggatgaaactgttccacctcagatcatcaggcactagattctcataaggagcatgcgacctagatcccttgcatgtgcagtgcacagtaggatttgagctcttatgagaatctagcgcaactgctcatctgagaggaggtggagctcaggcagtaatgctcactcaccctgctgctcacctcctgctgtgcagcgcagttcctaccaggccatgatgggtacgggtcggacaacctgggagttagggacccctgctccaagtgacccactgaaaggcaacctgaactagcaatttagcctggtaacaactgtcaatggagcaaggcacaggggctcacactcatattcccagcaacctgggaggctgaggctggaggatcacttgaggccaggagactgaggccagcctgggtgacatggcaagacctcatgtctcaaaaaattattatttaaatagccaggaggatcactggagctcagaaattggaggctgcagtgagcagtggccacaccactacactccactcctgcagcctgggcaacagaacgagaccccgtctgttaaataaataaataaataaataaataaataaataaataaataacaagtatcactggaggtatggatattaaccacagaggaatatggaacatagaacttaaaatcatgctacgcaggccgggcacagtggctcacgcctgtaatcccaacactttgggaggccaaggcaggcagattgcttgaggtcaggagattgagtccatcctggctaacatggtgaaaccccgtctctactaaaaatacaaagaaatcagctgggcgtggtggcacacgcctgcagtcccagttacttgggaggctgaggcaggagaatggcgtgaacctgggaggcagaacttccagtgagcggagactgtgccactgcactccagcctgggaaacaggtgagactccacctcaaaaaaaaaaacaaatcatgccagacagaagtccacccaaaaagactttcacagtaagctactgtatttacagtactcaagaaacactaaatgccagtgttctatccgtggtttaaatgtttttaacctcctaaaagcacaagagacaatgctttcatcctttcaaatgtctagatttttagaaggtagcttcccatagggacttcaagtctacttttaaagtcaggactgaatggttaaagcaatgaactagaaatccattggggtttcccggcacaggtctgaatcctaccaattaccgcatcttttcctttgcaaacgtgatttactgacccctcctccagatggagagcctggtatttactacctctcaggaagaagtgtgactgctccccaacctgaccaaactttccccctttatggacccagtaaaaaaaaaaaaaaaaatctgtacatgcctcctaaaggttactggtattctctgactgataaggcaaaaattacacagacgataatctcaacaatgaaatacaaatatgtaatcaacaaagataaaaagaatgctcagaaaagcatgaagccacctttaaagaaaattttaaaggacctgatatttttaaaaagagaatgttcaacatgttaacagataacaataactgaagcaatttgtacatctataccaaattgatcactaggttttcatctctgtattttgagcactgacaataaaaacaaagctctctgaaatgtgaaaacaaaatgttctcatttttcagagacactcctaaaaaaggcatgtttgaaattatctgaaataacaaatatactttaaacaactggcaaatattagcaaatttaagacatattttataaacaaattttaaagcatttttaggccaggtgcaatggctcacatctgtaatcccaacactctgggactgcttgaacccaggaattcgagaccagactgggcaacatagtgagacccgccacctctacaaaaaaaaattttttttttaattagccaggtgtggtggcatgcacccatgggtcccagctactcgggaggctaaggtggcaagatcgctcaagcccaggtcgaggctgcagagagctgtgagcatgccactggactccagcctgggtgacacaaactgtctcaaaaaaataaaatattttttaaacatacacgattatatgtaatacaaattaaagggattttaaggaagctggctggtctcatttagactggggcttggccttttcaactatgaagagaggtgtacacaagaagaaagagattccctaccttgccgcccagtaacacccacatgtgaccactccctgcttccacacgactctgcaaagcagaatcatttaaaaaagacaattctatgacataaaatcctccaactgcttcccactggtcttaggataaagggcaaaataatcaacctatatgggacctcccaagctctgtaaaataaaactctccacctacctcccagccgcgttctcttccttcagccttgttcacactagttccttcaaagcactctgcacctttcccacttggggcactacacaggtaattctctctgctgacctctcactccaccaccatccctccaacctcggtgccaccatcacaacctcagggaagccttctgatccctcccatccaggccggatgtcagtgcactgcactttcttattggattatgtgattgtccacctgtctcaatggacaccaaactccaagagatggcaatctatccctcttgttcaccatactgggatctactcatcaactatttagcgcatgctacctaccagatattgttctaaggcttaggttcatactgaggagcaaaatataaatcttgatctcataagagtttacattcaagtatgagaagacgggccatacataaattagtaagtaaattatatggtatgttatagtgtcataaatactatgaaaaaagtacagcaagaaggggagacaaggagagtgcagggcaggatacaccataatatatgtgactgttgtagcagactatccaaagaagcatgcagctgagagccagccacttccagaggccagtctctatggctttacatagaacaatgcactttcctattcctgctggatgacgggccttacagaaaaatcctgttgcctttcatctttgcatccctagtgttcaactggtcagaacacctgccacaggaagaaaatgaacccttttcttaccgtaatctcagtggccctcctttatgccaggccctttagcaatacttaacagaaaataaaaaatggaaaaacatccactaaagtttaaaagatacattttcaatattgcaattgtttcattttgggttaacatgatgtttttattttaaagcaaaataaaggtaagaaattctatggctatctaaaagggggcatttattttattttatttcattttttttcagacagagcctcactctgtcgcccaggctggagtgcagtggtgtgatctcagatcactgcaacctctgcctcccgggtttaagcaattctcccgcctcagcctcccaagtagctgggattacgagcacgcaccaccacgcctggctaatttttgtatttttagtacagacaggttttcaccatgttggccaggctggtctcgaactcctaacctcaggtgatccacccgcctcggcctcccagagtgctgggattacaggcgtgaatcaaagtgcctggccgaaagagggcacgtttttaaagactgagaaacagtataatttaaaggtcatgtggctaaattactctatctgaaaatactttatgcgctaaatgtagctatgaaaagtcagttaaaaacttgtaaatataacttttatactctataagaaactttctaatgtatgctttttgagtaaagattttcctatttgtttacagaaatgtgcaagtatacaatcagcaaacaatttctctggaacacaggtgggagatgtctttgagcattcttatctctttacttgaattactttcactaaacatctacagtttaccagtccctgggctgggcagaggtgacaagcataaaaagagaatctcactcacaaggagcttacattaattatgtgctaagtaacacaaaggtacacttagttgctacagaaacagagaagcataatctcagaagttaatgcaaagcagtctggaggactcctaaaatatctttttaaggatggtttaaggagctaagtaaatattttaaaaatttttttaaaggaggtggacattcaatttcagtcaaagaatctaccaacagcaatggctacaacgtttgcaacaccaaggtaggagagggaggcgtggtcctgattaaaaggtggggcagggcaagaaggaagacacagaagtggaagcacacacagggcgaggcctagggcagtcctgatgagtttctgaaaagaggccagccatcaggctatgccacactctggctacagtgcgactaaaatgatttgtgtaaataaaagagcattttattgggcaaatttatgcacatcagacttcataaagaacactttcagcaaagatcaagtctcatctctatgattatcatactccccctaaaaaactaagcagtacgctttcaaatttgtgttaaacatggccgggcgcagtggctcacgcctgtaatcccagcactctgggaggccaaggcagatgggtcacttgaggtcagaagttcaagaccagcctggccaacacagtgaaacccaatttgtactaaagtacaaaaattagccgggcgtggtggcacgcacctgtatgtagtcccagctactcaggaggctgaggcaggggaatcgcttaaaccctggaggcagaggttgcagtgagccgtgatcgtgccagtgcgctccagcctgggcaacagaacgagactcggtctcaaaaaaaaaaaaaaaaattgtgttaaacatgaaatactttcaatattgcaatgtactccatggtctaggtctcctaaccagggcaatggggttgatgggaaagaagatgtaaaaccagtagcatcactgaactgcaaatcctttatggttgaaataggagccatgacagcttcaccagaaaaactatgagaagacagagtttataaaggcattgaagggacaaaaggtattaaggtatggggtggcgggggggcagtgagaaagagaagggaaggaaacacagctgagttaataattttccttgttcctaaggaaggcatttacacacaggaaaaacaaagcattagaacgttaggggaaaaaactttcaagttggaatttatctcccttcttttgagaacctagcagttttctaccttacaattccatgttctaaaaaaggaattcattttccaatcaaaataactctagaagtagagtagttacaaagatatcaaccagcataagagcaaaaagtttaaactgaactaaactcagacctgatgaggttaactctctgagtgcctcatttacttcgtactctaaaataagcttttacagaaaaaggagaactcttcacatcaataaagttctacaaaagagcataagcaaggaaacccttacagcagtgtctgtttttaacaaggtattttccaaaaacatgacttcagtgttcatgtcttctccccattggaaaaaggttgttttgagaattttgtagaagaaattacaagaatatactccaagatttttgtgcaatttatcaatctgaaaagaatatccctaaatctgacagaatctataagagtactgtatgcatgataaaagcatatttaaaacttgtacctttggccaggtacgccgtggctcacgcctgcaatcccagcactttgggaggccgaggcgggcgaatcacctgcggtcaggagttcaagaccagcctggccaacatggtgaaatcccaactctactaaaaatacaaaaaaaaaaaaaattagccaggtgtggtggagggcacctgtaatcccagctactcgggaggctgaggcaggagaatcacctgaacccgagaggcggaggatgcagtgagccaagaacgcaccattgcactccagcttgggcgacaagagtgaaagtccgcctcaggaaagaaaaaaaaaaaaaaacttgtacctttaacactaggataaaaacaaatgaaatcgattgatggtaacacatctatacagcttttttacaactttgagaggccctaacatagacaacacgttactaagattagaagacctagattataatcctagctatcactattttgacggaaaatatgaattttaacatgacaatgaaataacagtgaaaggagtttgtcagccactccttggctggtaacatctaccatagcctatcactacaaaaacttgcaaatctatgtagagtagctgcagctacctgaaggcactgttcattgtaaacaccattaacaatttgatgtcccaatttgcatgttttgggggtggggggagacaaggtctcactgttgtccaggatggagtgcagtggcaggatcatggctcactgcagcctcaacctcccaagctcaagcgatcttcccacttcagcttctccaacagctggactacaggtgtgagccaccatgcctggctaattttttgattttttggtagagatgaggtctctctatgttgcccaggctggtgaactcctgggctcctaaactcacctaggcctcccaaagtgctgggattacaggaatgagccacctcacccagcctgcacgtattttagaactacattttaagataatgtgaagactgcttcataaaaacaccttaaatatatacttgtcaaaacttgtgcttacttatggaaattgcattaaattcaataaattctttaaatctcacttttaaaaatggcaatcttcccgaacattaaaccaaattacatttctccctgaatttgctgccacttaatttcagctactcttctacagaatagtacccatgttatctttttttctgtctggttcctactcaaaaagagtggaactgctttctccaaatatgcattctgtgctcagaagctgttttctctgcccagatacatgtgtaaacaagccaaaaaaaacaaaacaaaaaaacaaaaacaaaaacaaaactttctgctaatagattgacagctacaaggtagaatattttaaaaattcagtaagctgggcgcagtggctcactcctgtaatcccaacactttgagaggccaaggcaggtggatcacttgaggccaggagttcgagaccagcctgggcaacatgctgaaaccccgtctctactaaaaatacaaaaattagccaggtgtggtggcatgtgcctgtaaatcccagctactcggggggctgaggcaggagaataacttgaagacctaggaggtggaggttgtagtgagttgagatcgtgtcactgcactccatcctgggtgacagaacaagactccaactcggggggggaagaaaaaaatcagtaatagtgaaaatagcaaaaccagacaacatttccatgtttgtgttacaacagtcctaagaaaatgagattatcatcatccccctgttacaattgagaaaatgtaggcaacacgagggtaacttctaatgaataagccatgcctttgtttcatataaataagtcaactcaactcacattaacttttcaaaataccggataaaatttatttctaaccaatgcaagtttcaaagataagtacacaaattaaatttatgattaaataataagcttgttaatctgatgcctttcggaacgcatttcacttagcaaacctcaattaagctatttcttatatggtttgattacaaaactgcctttcagcatattaaatacaaggagaaaaaactgaaaagccacaacgatttcaacttctgtaaattaccctgactgtaatgaggggcgccaggcaggttggggaagtatggaaattgcacactgcacacaccacctgaccaccaagaaaaaagaggacaccactcttccccactgtggtcttcacaaactacaactcagcacctatttcaagtgcatttaaatattcaaacaactgaaactaagagaaaaaaactttcgaaagggaaaataacttgtctgtccccttcaatgttcaccttggagttgctctcatctctagaaaaaggcctcacgcatactgtttatacttacaaactccactgccctgtcaaggaaaaccttcctgttttctcagttatccaaaacttcaaacttccaatttactattaagacaagttattgggcatccacttagagaatctcaaacgaaagccagataggaggtagttttctacagctaggtttctcaagtttcatctcagccaagttttaagaacgttttacgtaaaaataaggggaaaagcaaaattacattcgcatgaagtttcgacgcacaacggcactgaaacggaaagactcttcacgttcccaagcgcaccctgagaggcaggtgcagcagctttccgatggcttctctgccgcccatgtatcccagccccaagaccaacacaggcaatcttcacatctgactttatttttttaactccttcagatccacctctgctcaagtctatcaacaggaaaacaggagcgttccaaacacacaccgagcaacaggatcccaacttcctggttctaaaggaatgcgatgccctgatgacccgtcccgccccgcacccgcacggccgcctatccgggctccggcgggaccgaggagcgagtggcaaggctggcgccgcactgcgggtgccggcgcccgcccggcctgggggcgctcgcggcccgcgaccccggccccgcccaggccctgcccgacccccgtcctcgccggccttcgcccaaccccggcctcccgaccctgaccccggcccggtcttccgggcacccagctccgtcgactcccgcctcgcctcaacgggtcctcctaagccccggccccggccttcccctgccccggcctcggccatcctcagccccagttttcccctgccccggccccggtcctcctcagccccggctttttcctggccctgaccccggtcctcctcagccctggcccttcccgtgccctagccccggtcctcctcaacccggccccggccttcccctgccccggccccggccccggcccaggcccggccctgcccgccgcggccgcgtcctccgggaagatggcggcgcagtgacaggcggcgcggcgcgggtccgagctgggccgggagggacggcccgccgcggcccagggtgcctcacctgtcagcgccgccgccccgcccgaccggccgcccgcgggctcctcgcctcaaccccggggcccggcggccgcgccacacgcggggacggcgaggagagagacggcagggagaggcggcgcggccgggccgggccgggccggaggtaggggagagggcgggcgcgagctggcggcggcggcggcggcggattcttcccctttcgggcccgaaaatgtctcaaccccgggactccagatccccaacgctccttcccgttcgcatgagaacacacagctcccacttccggggccctgcggaagtcccgcccccgcgcggacccgcgcctcgcgccctgaactcgcgcactcacccgccggtcccgcggactggcgctcagccccgggagagcctcacgtcatggtgttgcggcgcgctgattgggcgcacccgacgctcggcccgccccgccgccttcttggcctctccgcgcgtacaccctgctcgcggccttgcgattggcgcgtgcgcgcacatcgccccgccccgcgcacgccgcacgtccgccccgcccgccccgcccgccccgcccgccgtccccggcgcgaccggagcgcctgacgctggggggccgtgtgggccctgacttccggagggctgggccctggtcctccgccaccgcgtgcgccccttaaagacccctgcccgccgcccaggacggatggcgaccccggccctagcctgtccccagaccctggaccaaggccccggccctgccccgaacccctcatcccacccccaggacccaggccccgaccctggccacccaggacacgccctggcccttccccgaactcccaccccacagctgggatcaaggtcccggccctgcccggaacacctcaccccacacccgggacccaggccccggccctgccccgaactcccaccccacacccgggaccaaggccccggccctgccccgaacccctcaccccacccccgggaccaaggccccggccctgcccagaactcccaccccacacccgggaccaaggccccggccctgcccagaactcccaccccacacccgggaccaaggccccggccctgccccgaaggccccaccggggacccaggccccggccctgccccaaactcccaccccacacccgggaccaaggccccggccctgccccgaacgccccacccgggacccaggccccggccctgccccaaactcccaccccacacccgggaccaaggccccggcactgccccgaacgccccaccagggacccaggccccagccctgtcccgaactcccgccccacacctgagacgaaggtcccggccccgaagtcccaaccccacacccgggaccaaggccccggcactgccccgaacccccgccccacacccctaaccaaggcctcggctcagccccggaatccccaaccccacacctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagcatactctacctacccctgatcagtttatggaagaaaaggaaaccaaacaaagtatgttgcgtttcccttaagcttgctgcctgattttctggtttctgctctgattggctacatatacacatattatcaattattccaaattttaggtttgttcccccattaaaacggcttttcagggataccatattcatggttaaccgtgtacctgtgcttacaactgcttttttaattttgttttttgatacagggtcttgctctatgcaggtctgcactctgagctcagagtgctgtctcgggcccccaaaatctgggattagagatgggagccggtgtacccagcctgtgcttataatttttcgtactcagcgttcaaatgctgacaattctgcattttggaagaaagcctctccggcttcccatagtgggtagactgttgacatcaaggttgggtgccttctttgtgaaaccttgttgcatcctagctttaagggaatttgcaagttaaataattatattcatagtaatgtttttaaagaacatttaacgacataagacacatttcctttaatattaaaagcatgtacatatttcagaaaacttgcttacctggacaacctgccctgaccagtaggccatagtgtccttgcttaggtgcctggttcctttacctccacggataacctacaggagcttactcttggttcataacattgctagggccattgatgtggtataagtctaggaattctgccccaaaattggtaggttaaacttttttttttttttgagactgactctccctctgtcaccccggctggagtgccgtggcataatctcggctcactgcaacctcagtctcccgggttcaagtgattctcctgcctcagcctccggagtagctgagactacagccgcatgccaccacgcccagctaattttttgtatttttagtagagatggggtttcaccgtgttagccagaatggtcttgatctcctgacctcgtgatccgcctgcctcagcctccctaagtgctgggattacaggcgtgagccaccgttcccggctggtaggttaaacttcaatcttttttgtctatgtctacattccagcagacatctatgtcttacctattacaaaagaaagtaatgggatgggttcagtggctcatgcctgtaatcccagcactttaggaggccaaggcaggcagatcgcccaaggccaagagttcaagaccagtctgggcaatatgtcaaagccccatttctttaaaaaattatacaaaagtagccgggcatgtggtgcatggctgtggttccagctactcaggaggctgaggtgggaggatcgcttgaggttgaggctgcagtgagctgtgattgtgccaccgcattccagcctgggtgacagagcgagaccctgtctcaaaaaaagaaaaagaaaaaaactaaaactaaaagaattccatctcttctttctcttcgtattgtgtaatcctttccaacaatcagaactgggctttttgttccctcatgatcttctttttttcaaacctgtgtctcagaagaaacatccattttcaccttgagatgtgaggttataacatgaaatacattttcatggcatctctccttagacaagatcagttttttaaaactttagtataaatttctcaaaccatgatcagatacactccctcatttcccatgtcaagtggttacaaattctgtcaatcctacctaaaaactctttccttctccccgtccccccagtggttttgccgttgttactgctcacctggtttgattcagtggcgtcgcggttggtctctgctacagtccattactcacagtgccagcacatgtttccttaaaaagcttcatcaccatcctcctgcaatgcgaccttcaccggctccccgttgcctgcccaggaggataaagtccaagttctcctgtggaaagaagacccttcacacgctagtcccagcctgtcttcagcccagccccctgtgtttcctttcctgccttatcctaagacatccttaccttccaatcacactcactttccgagcatttttgaaggtattgagggagttgatgagtctacacttgaataaaatacagactttacactccagactgcacagttgacaggtaagtccacagttcatagtgtggacagtcctatacaaagaaatggagaggtgccccagctccagacgctgcgctgctctggaagtcgagggcggcattcttttggagcctgagcacttaggtcctaatggatgtgagtcccctggcctcaaatgtgcttcctgtacttggatgtctccttctggcggaatctcgcttatttttcaagttacagcccaaatgtcaaccactgaagtgttttagacagttgattttccttctgggccctattattagcacttgtttgtagctctgttgagctacatcacatcatacaattttcagctgacactactgtcatcccaaagaaatggtcaggcctcaagggcagaggcagcgagggcagtgatcttgggacaaagtctctaccaaacaaatacagcatgtgtatttctctagcagaggcctacatttcaagtggtgtctgagaacattcttttctttttcttttttcttttcttttcttttttttttttttttttttgagtctccctctgtctcccaggctggagtgcagtggcacaatcttggctcactgcaacctgcgcctaccgagttcaagtgattctcctgcctcagcctcccgagtagctgggattacagggatgcaccatgatgcccagctaatttttgttgttttttttttttgtttgttttttgtttttagtagagtcagggtttcaccatgttggtcaggctggtctcgaactcctgacctcaagtaatctacctgcctccgcctcccaaaaatgctgggattacaggtgaacattcttttattttatcccgaagcattttctgtgaaaaaataaacactacttctccaatgtgtagccgcattgctcaaaaattcatttttgatgatttaggactattcctttgcccattgattaaacaaatattcactgagtacctacgcggtctcagggactgctaatgttgcagagatcaggggagcatcacagatgagaagcaggtaacgagggatggagggtgaggatgagggatggagggtgaggtgaggctgtgtagagtgcttgggtggctcacaagcggggtccaagccaacttaagaaggaaccagaaaatgatgactaagccggggccagagacaaaccatccacgagaaggacacaggtgggaagaaggaggcagtgagtcacgatttactacgaggcaggccagacacagtagctcaaacctataatcccagcatgttgggaggccgaggcgggtgtatcatctaatgtcaggagttcgagaccagcctggccaacatggtgaaacacctgtctctagcaaaaatacaaaaaaattagctgggcgtggtggcggtcgcctgtagtcccagctactcgtgaggctgaggcagaagaattgcttaaacccaggaggctgaggttgcagtgagcgagatcgtgccattgcactccagtctgggcaacaagagtgaaactgtccgccccccaaaaaacaacaaaaaaccagatttactatgaggcaagaaagacccttagaaggttttgctgtggagtatctccagccacaaaagccactccaatagaaacacaataaggaactggcctaggcaaattaggtggaagtattaaaatgaagaatggtggtaatacatttgaatactgtgagtaaaaaagaacgcatgagcttttacagatactaagaaatatacgtgagtgggtaagtaaaaaatagtagcattgaggaaggaaaaaagaaagctcttctttacagtaaaatgctgattaatatatgaagaagagatttttttatttttatttttggagacagggtcttgctctgtcgcccaggctggagtgcagtggcgcaatcccagctcactgcagtctcgacctcctgggctctagtgatcctcccgcctcagcttcccaagtagctaggactacaggcatgcgccaccatgcccagctaatttttgcattttttgtagagacgaggtttcatcatgttgctcaggctggtctcgaactcctgggctgaagcaatccgcttacttcgacctcccaaaatgctgggattacagatgtgagccaccacacctggccagaattattttaaaaatcactatcttgtaaccaccagaattctggcaggaatcacaaatgaatgctaaaatcattgggtgaaactctgttgaggatatagattatgtacaccacctcaaagcttattaattgcttgttgcttattaatttcaaagggaaaggagtatttttacagtgaacaaatatgttagaccccatctgaatcaagtaatcaatgttagcatcactaataatggcggcctgaccccccctcccccacaccactatgtgtctgcctcagttatatggtattccggctaaaattcacaaacttatcacgaggaacaatcagacaaactcgaaggacattctgcaaatgacccataatctttaaaaatgtcaaggtcataaaagacaatgaacacttcaggaagttttccaaattataggagactaaggagagaagtcaagcatgacatgggcaaacctagattagctccgaggtcagaggaaacattcgctgtgattaacattactggattttattttattttatttatttttatttatttatttattttgagacggagtcttgctctgtctcccaggctggagtgcagtggcgtgatctcggctcactacaacctccacctcccgggttcaagcgattctcgtgcctcagcctcctgagtagctgggactacaggcacgcaccaccacacctggctaactttttgtatttttagtagacagggtttcttcatgttgtccaggctggtctcgaactcctggactcaagtgatctgcctgcctcagcctcccaaagtgctgggattacaggtgtgagccactacggccagtttgggatttgaatatggactgtgtgtcagtcttctaaccaaggctaaatttcttgaattggttctttttctttttttttttttttggagacggagtctcgctctgtcacccaggctggagtgcagtggtgtgatttgggctcactacaagctccgcctcccgggttcacgccattctcctgcctcagcctcccgagtagctgggactacaggtgcccaacaccacgcccggctaatttttgttgtattttttagtaaagacagggtttcaccgtgttagccaggataggcttgatctcctgctcttgtgatccgcccgcctcggcctcccaaagtgctgggattacaggcgtgagccaccgcgcccggccgaattggttcattgttttatggctgtgtaagagaatgtcttttatcttaggagatagcaatgaattatttaggggtgaggggttaagatatctgcaagtttctctcaaaaagtttagtgaaatatacacacacatatgaatgtgtgtgtctgtatgtatatgtctatatatacatctctctctctcagagaacatgacaaaaccttaattggtaaatccgagggtaggatatataagtggctgcaatttgtctgtaaacttgtaattcttcaaaatagagagttatcttgtagagacacattctgcagttatttatgaatgccatggtattatgtttaggattttcttctcaataatctaaagaggaagcagttggtagagacaggtgagaaataatggacaagtggcgtggtgaaaattgttgaagctgggtgtgatgggtacaggcagggttcctgacactcttctccctgctttcgcatgttttaaattccctatggcaataaaaacatagtaatgagatgaaggattttaattcgtcatagacattccatgacagcgtatggctcaaaaagcagtcagagaggactccacccttcctggctgtaggaaagagctctgggtctcccagcctgggaagccagggaggctgcagtggagttgaatgaaggagtcccgctcaggcgaggagggtgcaggcttggcgggaggggatggcacaggagggagcagccagggatgaaggaaccgcaagggtgaggcctgttaggaggtttagggtctgcaggaacatgtaattttggaaagaccctctctagggggagatgagaaactctgctgtgatgtattttataactctctagggctacagcctttgcagaagcccacattaaaggcctaggctgccctgaaacggcttcctgaagttggatgtgtgtttcctttgaaactaacaccactctggcctaagatgtctgggactgcagcttgtattcatgtgatttcttgcagaaatctgctggggtgtttaacctacacagcacccgtctacacataggcataaaattatcttctaggcctgagaaaaggctgcacttgcaccttgatgacttgcctggccttagcactcataaagaagaggaatgagttgatgagacatgagatttgggaaagactccccagttgaggattggatgtttcaggaagaggctgagaaccagacttcataagcacctggagaactggcaaagtggacattgtttttaatccaacatatatggagacttgactttttatttttatttattttgagacagagtcttgctctgtcgcccaggctaaagtgcgcagtggtgtgatctcagctcactgcaacctccacctcccaggttcaagcggttctcgtgcctcagcctcctgagtagctgggattactggcatgtgccaccacgcccggctaattttttttttttttttttttttgagacggagtttcactcttgttgcccaggctggagtgcaatggtgcgatctcggctcaccgcaacatccacctcccgggttcaagcgattctcctgcctcagcctcccgagtagctgggattacaggcatgcaccaccacgcccggctaattttgtatttttagtagggacggggtttctccatattggtcaggctggtctcaaactcttgacctcaggtaatccgcctgccttggcctcccaaagtgctgggattacaggcatgagccaccatgcgcgggcttaatttttatatttttagcagagatgaggtttcaccatgttggccaggctggtctcaaactcctgacctcaagtgatcctcccaccttggcctcccaaagtgctgggattgcaggcatgagccatcacgcccagctaatttttgtatttttagtagaaacagcgttttgccatgttagccaggctcgtcttgggccaggaacgtggcggggggaggggggcgcctgcccagaggaggccccagtgcctgaagtgggcatgaagagcccagcagcattagaggaacaaggactgacatgtttcccacagtggaaagaaagtttttgaaacagaaaaatagcacgggcatttgtggggtacataagaaagagacaaaatggaaccatttggaccagaaggcatgacgggagaagtgcgggagcgcaggagaggtgtgagctagtctcatcctggggtggccggtcaatgccagactgtgtccaggaggccactgcgagactttgaaaagatgtttcacatagaaattactgtatgcaggtgagaagcagaggttgacctaaacactgcagagaatgttggatggaaagttgggacttaaaatcttgatttggcaaaatcacagactcagctggagaggtgagtgttggccaggacatgggacccacttcctctaagacggacaggagctcagagccccggacttcagttttgtggacgaggaggtcaggttgtttgctgaagatgagggtggaccgatagggtggagaaacaatggggtctgtaaaaatgcttgaggcaggtgcttggaggaggacggacatttgccagtgtccacttcattgcccactcccacctgtgggtgctggggactcagcctgctcttcctcctcttcagagttgtcacctattgtgttcatggaagtccttctccaacccccatttaagaccagctaatcagggagagtcccaattccccatgagcttactttgttttgtttgtttgtttgtttgttttgagacggagtttcactcttgtcgcccaggctggagtgcagtggcatgatctcggctcactgcaacctctgctcctgggttcaagcgattctccttcctcagcctcctgagtagctgggattacaggcgcctgccaccatgcctggctaatttttgtatttttggtagagatgggcggggggtgtctcaccatgttggccagtctagtcttgaactcctaacctcaggtgatccgcccgccttggcctcccaagtgctgggattacaggcgcgagccactgcacccggcctgatcttgctttttaagcgattgcaattccacctggtgctatggtgatctggggttccatggcctgtttaccagaagagcaatgcttttgttgtgctatattgttatttcagttatttttttattttttattttttgtctttttttgtttgtttgttttgttttgttttgtttgagacagggcctcagcctgtcacctagactggagtgcagtggtgtgatcatagctccctgcagcctctaactcctgggctcaagcgatcctcccacctcagcctcctaagtacctgggattataggctcaaactagcatgtatggctcagtacatttttttaaaaatctgcattatgtatatcttgaactatacctagagaagtatacattggttgaaattttgaggtgaacaaatgtgccactgttcagaaacattctaatcacattctccactgttcgaaattccccaaggtatctatttttgccttaatttatattccctatgttaagaaggtcatttgagcacattttcatgtttgttagctatttctatttttcccttgcctgtttagatctagatttattacaagaagtccatgatggagacagctcaggaatggaagaggtgagaaataattctgtcaaagaatatgggggtgttgtagggaaccggaagatgagggcagagaagggattgaagctgcctgattgcgtgaccttcccaggatcccgatccctcactggttccaacaccagattccatgttcctcctctcccctaagttttttctccggagtcagatgcatttccctaaaataatttattttaaccaggatcttcttttacgaatgtcctatttgcacagactcaagcccaaagatcagaagaacctctgtcctggaagtcggttctctttccaatggaacagcctctgcaaagtgtaccacacgatgagttaatatatctcacttttagaaagaaagatactgatatgccactgatgtggtttggatgtgcgtccctccacccccacccacagtcccatgctagaagtgtcactcatattcagctttgaatcagtggggaacccatacaggaagatcataataaatatggaaaattctgataattttgtgattccatgagataagaaaagaacttccctctcctggaaatctcactctgaggggagccagctgacatatcttaggcctccctgcacccctgggagaggcccacatggagaggagcccacagccaaggaggccttttggaactgggccctccagcctcactccagctttcagatgatcacagtccaagctgacttctttttttttttttttttttgagacagagtctcactctgtcacccaggctggagtgcagtggcatggtctcggctcactgcagcttctgcctcctgggttcaagagattctcctgccttggcctcccaagtagctgggattacaggcacacaccaccacccctggctgatttttgtaattttagcagagacagggtttcgtcatgttgcccaggttggtcttgaactcctgacctcaggtgatctgcctacctcggccttccaaagtgctgggattacaggcatgagccaccgcacctggcctcacaagtcctttctgaaaccacagatgggcactttgcctgctgtgtgttattctgggacttcagcagcctccctcctcctgtcacctccatccatctgtgggatgcacatggagcctcttcacaggacagcaagcatttgaacatagcaggaggatgacctggggccagggttttttgttgtgtttcattttgtcttttcgagacagggcctcactctgtcacccaggcgggagtgcagtggtgcgatcatggctcacggcagcctcaacctcctgggcccagatgatcctcccacctcatccttttgagtagctgggaccacaggcatgtgccaccacatagggccagttttcagcctccattctgagtggttatgatttctgttgaattctttttccaagaggtgattgggtgagctaagactgacattataaagtatttttaaaacaaggttgtgaaggaagcagtgagcggcgagggtgatggagtggagggaaggtgcaggggggcccaggtcaggagggcccgggtcgggagggcccggggagtgcagcggcatttccggggtaattgtgtctacttcgcagctttcttggtggtgtccacgtaagctccacaacatcagagccgctgctttatccccagcacctgatacaggcaccattgaagctcactgcagcctcagcgggatgggtgccttacagccctacagggctgcagaaaatacggaagaacatgaatagcatgattcaaaaagaaaaagcggtcttactggtgcataacaaagggaattaggaagaaatgaaccaaagacaccttgaattttgaggtcagacttgtctgtttctttagaattcgtggtaaagtactgaacattggctgcataaattatttacatacttgtcacggtgtagccgaggactaaaacttcaacattcacctgctaccaacctccgaacagtggctgtgtttgtatcaagttacctgaatggtaggtggggaagtccaaatattcctagtaagacaattgcattcaaggcctggctggtgaaacctgtttcctgggaaggtagttagttggttttcaccacagggagaacctggacatcattcaacatcatcagcctgggatatggctcccagaagaggttggaggggggatcttggagctggcagatttgggtttgcatgtcaacccccagctcgcccctgccctgtcacccccaagtctctgcttccccatctgcatggggactgacctcgcgttgcaatgctgctgtaggtatgaagaaacagcatagcctatgtgcctgccactcagccagcgctggggaaacagcactcctttcctgccagcgccagtgccagggcaaactccagctgtgggcatctgctgtcagccccacgcgtgtctgggcgttgcccccgccctgccttggtgtctgcccgtgactcacttttcctgctgccttcagctttgagttcctgtttcccatcttgaagtcctggccctaagttctagtttctgtttctggtgttctttgatttctaattaaatccagtccctaaatggttggctcaagtcggcgtctaaaggcgattctctgacactgtgaatctcaggagtgcattacagtccaagtcgtacttagaattagtggccagtaaattgctgatagtctttaacaaatgttagcaatttggaattcaagaagtgcttgttgatacttgtgtttatggattttaaaatgtttccaattttttacgtattacaaaaaatataagcatagattgtaaccacgtttataattcatattttataaatgtatttttaaaaataaagacatttttaaggctgggcatggtggctcacccctgtaatctcagcactttgggaggtcaaggcaggtggatcacttgaggtcaggagttcgagaccagcctggccaacatggtgaaacctcgtctctactaaaaatacaaaaattagctgggcattatgataggcacctgtaatcccagctattcaggaggctgaggcatgagaatcacttgaacccagaaggcagaggttgcagtgaacggagatcacaccactgccctccagcctgggtgacagagtgagactctgtctcaaaaaaaaaaaaaaagacatggtccaggcatggtggctcacacctgtaatcccagcactttgggaggccaaggcgggtggatcacaaggtcaggagatcgagaccatcctggctaatatggtgaaaccccgtctctactaaaaatacaaaaaaaattagccgggcatggtggcgggcgcctgtagtcccagctactcgggaggctggggcaggagaatggggtgaacccgggaggcggagcttgcagtgagccaggatcacgccactgcactccagcctgggcaacagagcgagactccgtctcagaaaaaaaaaaaaaagacattttagcattactatgtgttaggaactgaatgtatgtgtccctccacaaattcatgttgatgccttaacccccaccatggctctctttcaaataaggaagtatttatagttagttaagttcgtaagggtggggccctgatccaatgaggttgtgtccttataagaagagacagcagagccctctgtcatgggaagacactgcgagaagctgccatctgcctgccagggagaggccctcagcaggaacagccttgatggccccctggtctcagactccagagctgcaagaatgtaagcccagcctgtggtgttttgttacggccagcggagtagacttgtaccccatgcagcggtgtgtctatgagccttctttacatcttgaattgaagtcaacttacagccaggaaaaactcaattacaacaggataaatcccggaaaaaaggtctctctatggatatcatttgctgccacttcttcacatttatcgttttttggttgataccacatcacagaatactgaaaatccactagcaaacataaaaatgaccttttaaacattttgcattctgtctgaaaatttctggggaggcctttacacccctttccttctgtgggaaactttctaggagctgaagtttctatgccaattacatcagctgcctctaaagcgaaaatacaaagattcttaaattgtctgattagggataattgtgatttttaaagtgacatttatccaaaaggatgtagaaaggtaagcaagttactttcctgattcacttttaggttggttagagtggcagtttctgtttctccagttatgaaagaatctcatagggttagggaataggcctttcctttaaactttgtcttgtaattcagtgtggtaacatgaccggggttgggggacccctctctctctctaaattttggcaagttatttaacctccttggggcttgttccttccatttgttgaatgaaatactgaactagaaactattctgtgactgaacagagcagttatatcaattttttttatcttacaagttcacctccctcctcttccttgccaccctccctctttgtggaaaacattcagtgatgagaacttaagtcaaaggtgcctggccatgagaacttccatacttttgactctgaaacaccatttttttttccttttgagacagagtcttgctctgttgctcaggctggaattcagtggcgcaattttggctcgttgcaacctccacctcctgggttcaagcgatttctcatgccttaacctcccgagtagctgggattacaggtgcatgccaccacatcaggctaatttttatatttttagtagagacaagttttcaccatgttgatcatgctggtcttgagctactgacctcagttgatccacccacctcagtctcccaaagtgctgggattacaggcgtgagccactatgcccagccggaagcacttttatctgccagtctccagaagtaaacctatttcagactgacaaggaagcaaggcagcgtttcatcatctgcgtgtcttgccggttcttgccaacaaacaaacagagttctgttctgcttctttcaggcatggaagatataaggcacagttccattcagcaagacaaacggcaaatatgctgtggctctcgggggcaggatggccattgagtgacccacatattctgaggccatcacaaccccgtcccaggcagtcagaacacaccacgcagtcccagaaaggacgaaagaagtgacagcctgctacgacagaacaaaatgttctgtggccctggaaggaggaggctgaggagtctccgattttcttgattgactgaggaatactggtttcttctttaaatgtaaaaactcccaaatcatgaccttaatgaaatgagttttttgttttgttttgttttttgagacagagtttcacttttgttgcccaggctggagtgcaagggcgcaatctcggctcaccgcaacctccgcctcccaggttcaagcaattctcctgcctcagcctcccaagtagctgggattacagggatgcgccaccacgcccggctcatgtttttgtattttagtagagacagggtttctccatgttggtcaggctggtctcgaacttctgacctcaggtgatctgcccacctcggcctccaaaagtgctgggattacaggcatgagccactgcacccggccaatgaaatgttttttaaattaacaaatcaaacaaaagtggctgaaaacttaccacgctgaaactgctggcagtgtgatagtggacctgagacctgaggagggcagcacgggagacccccaagagtgaggtcctcctgcctggagctgcgccgactgcccaccgcccaccacccaccaccgagattcctgcgctgctccctgctgatggggcccaaggcatgcattcattcagctcacacacggtcaaagaccaagctccaaatacaaagccacgctgcctggtttttaaaattaaactgttaattttgagataattgtagcttcatatgcatttgtaaggaataatacagagaggtcttgtgtattgtatctggagtacagtgacctgatctcggctccctgcaacctccgcctcaaaggttcaagcgattctcctgccttagcctcccaagtagctgggattacaggtgcccaccaccacaactgactaatttttggcatttttagtagagacagggtttctccatgttggtcaggcaggtctcgaactcctgaccttaggtgatccacccacctgggcctcccaagtgccgggattacaggcgtgagcccccgcgcccggcctcagtggtcgcgtcttgcacaactgggggacaatatcaggatcctgacttgtggcccaggcacagacgtccacccccacaggaccttctgctccctttaaagccacagaacttccctcccatccctgcctccttctcagccctggtaaggcctccattgctgtacttggatcatttcaagaatgttctataaatggaatctcatggtgtaccaccttttggtctggactcccttcaccagggccactctgaaggtttgttcaggccgtggtgtgtgtgcccatagctcgttccttttcactgcagagtatactccatagtgtgggttatgtcgtctgcttaaccacacaccggttcaaggccatctcggtagcttccagtttttgaccatgatgaataaagctactacgaacagctgtgtaccagttgtcatgtgaacgtcagtcttcgttttctccgggatgaacaccctggcccgaagttgccaggtccgacagtggttgcatgtttagtttgttaagaaactgccaacccgttttccaggtggctgtaccatcttacatcccaccagccccgagtgagtgaatgatctccaacccatttcccaggcggctctaccatctaacatcccaccagccccacgtgagtgagtgatctccaacccgttttccaggcagctgtaccatcttacatcccaccagccccgcgtgagtgagtgatctccaacccgttttccaggcagctgtaccatcttacatcccaccagccccgcgtgagtgagtgatctccaacccgttttccaggcggctgtaccatcttacatcccaccagccccgtgtgagtgagtgatctccaagttgttttccaggtggctgtaccatcttacatcccaccagtcccacatgagtgatctccaacctgttttccaggcagctgtaccatcttacatcccacgagccccaggtgagtgacctccaacccgttttccaggcagctgtaccatcttacatcccaccagccccgggtgagtgatctgctctccccgtcctcacccacgtgccgctgcatcactctgttattttcagccatgtggatagatgtgcagggctgtcttgttgttgttttaatttgcatttccctaagggcccactatgttcggtgtcattctctcggacatctcttcttgtgcttatttgccattcgtatcctctttggtgaaatgttttttcctgtcttttgctgatttttctaactggactgcactttttttttctttttttgacacagggtttcactgtattgtcgaggctgcagtgcagtggtgcgataacagctctctgcagcctcagccttccaggtagctgggactacaggtgcgtgccaccacgcccagctaatgtttgttttttctgtatagttgaggttttgccatgttgcccacgctggtcttgacctcctgggctcaagcaatccaccctccttggccttccacagtgcttggattacaggcgtgagccactgtgcctggccttagcttttttttttaaccgttgagttttgagagttctttgtatatttgaggcactaatctgtgttggatatgtagtctgaatatattcagaatattttctctcagtttgtagcttgtcttttcatcttcttaacatagccttttgcggagcaaaagtttttattttttgtgaagtccaatttttctatttttccttttatatattgtgatgctggtaagcaatcttatatattatcatgctggtaagaaatcatttcttagtcttcaatcccaaagattttctctgtttattttctaaaaggttgatagttttgcattttacatttaagtctgtgatccattttgaaatcaggtagattgagtccatcactttattccttttcaaaattgctttagctactctcattcctttgtctgtacatagagattttagaaaaatcttctctatgtctgcatgacatttgctggcatttcaataggaattgcattaaatctatatatcattttgggaaaaatgatatttttgctataatgagtcttccaatcgatgaacaccctgcgtctctctctttatttaggctttctttgatttctttcactggcattttgtagttttcagcatatagatcctgtacatgtcttagatttatacctaagtatttttttgagtgactgtaaataatattgtattattcattttggtatctttgtattcattactagtatatggaaatattattgaattttgtatgtttgtcatgtatcctgtgatcctgatgaactcacttgttagttgtaggagggtttttttttttgagattccttgggattttctctgtggacaatcatgtcatctgcaaataggggacagcttctttccgtccttcccgcctgcctgtctgccttccttctctctcagtctctctctcccttccttctctctctctctcagtctctctctctttcttcttttccctttattttctgtttttgccttattgcaatagctaggactgctagcaccatgttgaatacagtggtgataacaggcatccttgccttgttcctgatcttaggctgggagcttcagtcttttccattaagtatcctgttagctgcaggtgttttatagatgttctttattaagttgaggaagcttccctttatttctattttttaacagttttttaggccgggtgccgtggctcatgcctgtaatcccagcactttgggaggctgaggcaggtggatcacctgaggtcaggagttcgagaccagcctggccaatatggtgaaaccccgtctctactaaaatacaaaacttagctgggcatggtggtgggtgcctgtaatcccaactcgagaggctgaggcaactagaaccgcttgaacccatgaggtagaggttgcaatgagccgagatcgcgccactgcactccagcctgggtgacagagccagactctgtctaaaaaaaaaaagtccactctgcagagatggctgaattaaaaacaatgtccactttgccaggaacttcaaacaggagaccaagtggtgacttcagggacatccagggtgatgttgcatcccaggacgagaagaggctgccactaggagccacagatagagctccagggagtttaacatacaacctttaagaggaagaaattgcaccagcccagaatcaactgcataacagacaacctttaaaacgaagaaatcacaccagcccagaaccaactgcataacatacaacctttaaaaggaagaaatcgcagcagcccagaaccaactgcataacatacaacctttaaaaggaagaaatcgcagcagcccagaaccaactgcataacatacaacctttaaaaggaagaaatcgcagcagcccagaaccaactgcataacatacaacctttaaaaggaagaaatcgcaccagcccagaatcaactgcataacatacaaactttaaaaggaagaaatcggcctggtgcagtggctcacgcctataatcccagcactttgggaggccaaagtgggtggatcacaaggtcaggagatcaagaccatcctggctaacacggtgaaaccccatctgtactaaaaataaaaaaaaaattagccgggcttggtggcgggcacctgtagtcccagctacttgggaggctgaggcaggaaaatggcatgaacctgggaggtggagcttgcagtgagctgagatcaagatgctgcactccagcctgggtgacagagcgagactccatctcaaaaaaaaaaaaaaaaaaaaaaaaggaagaaatcgcagcagtccagaaccaactgcataacagacaacctttaaaaggaagaaatcgcaccagcccagacccaactgcataacagacaacctttaaaaggaagaaatcgcaccagcccacaaccaactgcataacagacaacctttaaaaggaagaaatcgcaccagcccagaaccaactgcataaaagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccacaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccacaaccaactgcataacagacaacctttaaaaggaagaaatcgcaccagcccacaaccaactgcataacagacaacctttaaaaggaagaaatcgcaccagcccacaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagtccagaaccaactgcataacagacaacctttaaaaggaagaaatcgcaccagtccagaaccaactgcataacaggcaacctttaaaaggaagaaatcgcaccagcccagaaccaactgcataacagacaacctttaaaaggaagaaattgcagcagcccagaaccaagtgcataacagaatgggccccagtgtgtaattggcaggatttgctggaagatgtctcctaggatgcgctagaagcatgaagagacgccggttgtaaggcttctgcctcaggatgtgtaggctaggcagtccagccctctggagaccactgaagaggcagcattcaaagtcttctggaaaacatcagaggactaacaggacatgaagaatccctgagcaagctccaaggaaagacgggagctcgcttcagcctggaggcgtttgctgattcggagcaaggggaaggcaaggtgcaaggcggaggccaggcctgccaggcagagccacatgggtttatcctggagtcctgtctgtgtgtgacattggccgggagggctgcacccttgctcacaccagcagctgggcagcctaggaagtccgaggcacgcaggctggatctccgtggccttgggaacatgctcattagtttttgcgccatctgctgcactttgagctgcaaagtcgagaccacctacagcttcagccaaaggcctgtcttttatggtggcctgtgtccaccagcccgtcttttatggtggcctgtgtccaccagcccgtcttttatggtagcctgtgtccaccagcccggctggggaagggctcctgctccaggcctcctacatgtggacgcggacgaaaagggggctctaaacaaccagtaggaaagaagtgtgtgataaggacatctgcggcagtggtgaatgtgatggaaagacgggggtgtgaggcagagccagggagggtagctgggctcattcagaccggtggctcagagaagaggtgcgaaaagttgggccccgtggaatgggagtcgggacatggccttggctgcctgaggtcgggaggaggacacagctgctgcgtggagtcacgggaccgagaggccacagaacctaaatgggacccgtgggtctgggggtgcggccgtgagtggcagcggagtccttcagggtaccggccgggcgcattcgctcactgctggtgcgacacatgcatggcagatgtctcctccccgcacttcccaggacagctcccatccacgcttccccaggacagctcccatccacgcttccccaggacagctcccatccacgcttccccaggacagctcccatccacgcttccccaggacagctcccatccacgcttccccaggacagctcccatccacgcttccccaggacagctcccatccacgcttccccaggacagctcccatccacccttccccaggacagctcccatccacgcttccccaggacagctcccatccacgcttccccaggacagctcccatccacgcttccccaggacagctcccatccacgcttccccaggacagctcccatccacccttccccaggacagctcccatccacgcttccccaggacagctcccatcccacagccacactctcgggcagctctgacactcctcccaacagtaggctcacattccctccctcttcaccccagggggcttctgaggtggtggaggtaacaccccgacttctgaactgagggccccacccctgcctcacttcagtctgcccctgccccctcgacccagccaggactgcagcccgtggggggcccacaccacaggcgccaggcaggctatggggtggcagcttaggcaggtgcctgagtacactgccaggtcgttcttccttgtccctagtccccaagggattagaagggtttctggcacttctgtgcttcctgagatgactccctgttctgtggttttggtgccagtaattgataaacctccaaaatgctgctgattggagcatgtcctcgctcctaacactcagaccttcaactcgggcctttgcctcttcaataagaccctccacggcccctccacacgtgtctccacctgttgcccaggacggggagtttacgtttgctaacaccatggttattaaagagcttttccgggctgcctgacttcaaaatctggagagcttagtgttctttctgctttaagttgagttgtagcaggaaataaacaaagtaaggactgccctattcactggaataacttgaaactgcactgttaattaaaaaaaaaagaactctaatcctttgaaaatcctggcagaaaggaaactgtgtgaggccatttggaaacctggccttgagttcctcctctcactcccacctgaggcgactgtttcccctctcacgcccgcctgaggccactgttccccactggctgagcgtccttccctcccaccctggcccctgcagtttgaggctcccacttcctgccccagtgcctgccaggtgccccacagaggtggggacacaggatctgcaggacaggaggctcctgccaggtttccggctaatccaccaaatgggcaccttctttgcacagcggctctgggagctgactcagatggcaatgactccacgaaccctgacagattccatcaaattatacccaagccaacccctacagctgagcgtgacggcagcttggagctggacggacaccacaaactacacagttacgttatgggagtacgtatgagcccctgactatgggcccaggagtacacctgcgtctaaggggttcaagcagtgttgtctcactcagaaattctttttttttttcttttttttgagacagagtctcactgtgtcccccaggctggagtgcagtggcgcgatctcggctcactgcaaggtctgcctcccgggttcacgccattctcctgcctcagcctccctagtagctgggactacaggcgcccgccaccacgcccagctaattttttgtatttttagtagagatggagtttcaccgtgttagccaggatggtctcgatctcctgacctcgtgatccgcccgcctcggtatcctcggtatcccaaagtgctgggattacagccactgtgcccggcccaaaaattctttaatttaggattccaatcagcctaaaagacaagcactaagcagtttccgactggactgctccctggagggtgggctgtgggctacaggatccagggctcccacacctgttgctagagccatggcctgtagccgagaggaaagtccctccaggcccaaggtatgtggcttggagctaggcctggggggtcaggagaagggtaaagacactgcaggagctcttaatttgggccaggaaggtgacgcatgagataggatgtaggcagacactgaagaagagcttgacatctccaaggcctcgtctggagcctgagacgcggtgaacagtttgctcctttacatcctgtcattctgtgatgggaatgaactccaaatgggaaaacagcaaagcctcaaatcccaaaccagcagccctgctcactgttcagaagcacttttgtgatgggagagtgcaagctcttccttccggggaatctggtccttctcctgaaccctcttatttttttacttttatttttatttttgaaacaaggtctttgctgtgtcacccaggctggagtgcagtggcacaatctcagctcactgcaacctgcacctctggggttcaagcgattatcctgcctcagcctcccgagtagctgggattacagacgtgtgccatcacactcggctgatttttgttttgtttttagtagagacagggtttcactatgttggtcaggctggtctcaaactcctgacctcaagtgatccacccacctcggcctcccaaagtgctgggattacaggggtaagccaccatatccagcctgtagttcattactctattggcaattttgggattgatgatgaatgtttttagatacttatatgaattgcttatttgtcgattttggagctggtgttcttattttattgttagactttgtataccaaaaatataaatgctttttaatatgtgatgggattattttttgggttatatgtatccttaattgtgttcttatgacactcaaatataataaaaattttataaggttaaatctaagctttgcggggtatgattttggccttttgaatcacgcttagagattttataaaatattcttgcctgtaatcttacccttttcaattcattttctttcttttttttttttttttttctgggtctggctctattgcccaggctggagtgcagtggtgtggtcttggttcactgcaacctctgcctccctggttcaagccctcctccctcctcagcctcctcagtagctgggaccacaagtgtgcaccaccacgcctggctgatttttgcgttgtttgtagagatggggtttcgccatgttgcccagactggtctcaaactcctgggctcaaacagtccatctgcctcagcctcccagagtgctgggattacaggcgtgagccacgatgcctggcctccgattgatttcctccgcgtaactgtggtatgttcctaaagtgcccactgggttgtcacttggatttgctcaacatccacccggtgctccccgcagcccttgggctgaagggtccctgagagctgacctgtcttgctggtcagctgctccctggcttagctgggtgcttgcaaacctgcctcttctgggacctgactatctgaccactgtcaggcccagggacaccggctgcacctgggcgcagacaccccgtgaaagcaccttgttcctcacgctcagtgccttggcacgcaccactacctctcctgatgttcttctcctttcttcaagggacctttgaaatgtttaagcatcctgcagcctaaggcaggtccctttctcttgatggctgccaagaaaagcacctgtgtagccttgctggggatgttggtgcaggtgttatccacccaccagggaaggcaggggcctctgcacaccccacacctctgatttatatcttcccctaaaattatgtcataaacatccttctttgttagcacaaaagtacctgcctcaggtcttcatagctccacagtcacctgaagggacgggtgaatccgtttagccgctttctctgctgacctcatccaagtctcaccacccagtgtttctcctgtaaatggtacagcttcgcgtagacacactgacaacgttcatgggggtccacgtggagtcacaggcctgctgcccacatcacccactatgccagcttggacttaaagtacttatcagagacttcaggttgaacatgaaacattaattctgaaagaacagaaagaaacaaaacgcattagaccagaaggacaaagagcccaggaggagcaacttcagccaggatggagtggcatttggaagagtggagtctctgggcagaggaaggacgctccgcctgaggtccccacaggcaacggccctgggctggtggttgccgagtccctggagatggcagggcagggcaggtggactaggtgtggttgacagtgggtgctggctgagtttggatatagagtttgtggtcccaggacaccttcagagaagtttggaaaatttattcctgaaaatgtgagatgtactgggctgcaggggtgtggaaatatgcgtattctcccctagtgatgcaactgctgggaagggaaatttggcagcatttgttggtgaaaggtgtaaagcaggcattcctgctggttcagcaatcccacctcctcatcaatcccacctccccgtcaatcccacctcctcatcaatcccacctcctcatcaatccacctccccatcaatccacctccccgtcaatccacctccccatcaatccacctccccatcaatccacctccccgtcaaccacctccccgtcaatccacctccccgtcaatccacctccccgtcaatccacctccccgtcaatcccacctccccgtcaatccacctccccgtcaatcccacctcccccccgtcaatccacctccccgtcaatccacctccccgtcaatcccacctccccgtcaatccacctccccgtcaatccacctccccgtcaatccacctccccgtcaatcccacctccccgtcaatccacctccccgtcaatcccacctccccgtcaatccacctccccgtcaatccacctccccgtcattcccacctcctcgtcattcccacctcctcgtcattcccacctcctcgtcattcccacctcctcgtcattcccacctcctcgtcaatccacctcctcgtcaatccacctcctcgtcaatccacctcctcctcaatcccacctcctcctcaatcccacctcctcgtcaatcccacctcctcgtcaatcccacctcctcgtgtcccctcatgaatcacccacacatgggcattcttcattgtgaaatgtcttgcagttgttggaaacaagattgttcaacaatagaaagaatgagcgatcaagccatgaaaaggcatggaggaaccttgaatgcatgtcactaagcggaagaagccaatctgaaaaggccacattctctacgagtccaacgacagaacgttttggaaaaggcggaactggggataataagatcagtaataagatgagtgattgccaggggttgacagagggggagggatgagagggggagcacagaggattactaggccagtaaaatgattctgtaggatactgcagtggtgaatccatgtcatcatacatttgtccaaacccataggatgtacaacagcaagactgacccccagtgtaaactgcggactaagaacgggagggaggcgctgggtatggtgggaggcgctgggtatggtggctcactcctgtaatcccagcactttgggaggccaaggagggtggatcatttgaggtcaggagtttgagaccagcttgtccaacgtggtgaaaccccatctctactaaaaatataaaaaaaattagctgggtgtggtagcacacctgtaatctcagctactcgggaggctgaggcaggagaatcacttgaacctgggaggtggaggttgcagtgagccaagatcatgccactgcactccagccagggcaacagagtgagactctgtctcaaaaaaaaaaaaaaaaaaaaaaaaaaaaaagaatggaagagagggtcattaccaaatgattgatgaattaattatgtaattaacacggttaatttcagggaccccttagagcattgaggactccactctggcatgtaaggagctgggatgtcatcatttatattctcagaacaagaaaaaagcacaacaatgtgaaaatcaacaccttttctttggtctgccacagaatcgaggcatagggaaaaatcactgcccaaagccccagagaggcagaacacagaggagcacagcaggagcggaagccccgtgtggatccagcaccagtaggaacgccaaactgccactgatgcctgctggagtgtgggaagacaaaaccacctacctaagttctgtgtccagtgaaattacctgaggggatttgttgtcagtagatctgccttgcaagaaatgttaaaagaagttcttcagagaaggaaaatgacgtaggtcagaaactcatatttcttcttggctcgttgatggctgttgtcttagtccattcgtgttgctataaaggcacacctgaggctgggtaattcataaagaaaggaggtttatttggctcacggttctgcgggctgtacaagaagcatggtactagcatctgcttcaggtgaggcctcgggaaggtccactcatggcggcgtggtgccagcatctgcttctggtgaggcctcgggaaggtccactcatggcagcgtggtgccagcatctgcttctggggaggcctcgggaaggtccactcatggcagcgtggtgccagcatctgcttctggtgaggcctcgggaaggtccactcatggcggcgtggtgccagcatctgcttctggggaggcctcgggaaggtccactcatggcggcgtggtgccagcatctgcttctgatgaggcctcgggaaggtccactcatggcagaaggtgaagaggagctgcttgtacagagatgatgtggccagagaggagacgagagagagggggcaggcaccaggctctttttaacaatgagctcttgggggaactcatagagcaagaactctctcattcctgccaggacagcaccagccactcatgagggatccaggggcataacctgaacacctcccactgggccccacctccaacactggggatcatatttcaacatgaggtttggggagacaaatatccaaaccatagcaggcaacttctccctgtgtcttcctttcatcttccctctgtgcacttgtgtgtcccaatctcctcttcttataagaataccaatcctaggccggacatggtggctcacacctgtaatcccagcactttgggaggccaaggccggtggatcacctgaggtcgggagttcgagaccagcctggccaacgtggcgaaaccccatctctgctaaaaatacaaaaaaaattagccaggtgtggtagctcatgcctgtaattccagctatttgggaggctgaggcaggagaatcacttgaacccaggaggcagaggttgcagtgagccaagatcacaccattgggactccagcctgggcaacaagagtgaaactccatctccaaaaaaaaaaaaaaaaaaaaaagaataccaatccttttgggttcgggcccaacaatatgacttcatttaaccttattaccctcatataggccctgtctgcaaatgcagtcacatggggggttaggacttcaacatgtaaatttggggacacacaactcagtccgtaagagtgcaagggagaggtcaaggcttaaaataagaatttggcttccttgacacagagatgactgtactcagtgaccctcctcctgtcatgtgtgggacaaacctgttagcttggtgtgatacaaatcctgtgattatgcaatgtcatgtggcaaaagggatttatagacggaatcaaggtcccaagccagttgactcagttaatcaaaagaaaaataatatcaagtaggcctgacccaatcaggtaagctcttgaaaagcaaaattttcctctggctggcctcaaggaagaatgcagagacctaagctttgaactcccactggccaacagccagccaaagccagggacctccctcagacaaccacagggtctgacttctgccgtagcctcagtgagctcggaagaccaccggaactcactccagaggagaccacctgaactccagatgagaccacctgaactccggacgcagcctcccgagaccctgggcagagggctgagcttcacgtgcacagaattctgacctacagaagctgaggtggtagctggatgttgctctccactctaagcttgcactaaactgtgcagcagtagcgtttcccagacttgccatttcctttctccttctccttcctccagcctgtggccaggtgcctgctctctgcaccccacataccatggtagtccaggccttggtcctcccccaccccaggatcaccacagtgacctgctatttttaaccatatgtttaaaatggggtaggaagacagaagcatgtcaagttcatgaagcttgagttccagagacaccctgacttcacaagtgagtgaccgtggatctttctcaccccatcatcttctttcttggttcattttcaccacgtgcttcttatccaccacgctgctattccttgacatgtgctctgaggaccagccattgcacatggcttggggagctggggccctgcctccaacgtgcagaatctgaatgatcagcacagggctgggcatttgcgtgttctcctgggggcttttggatatattaaaatgtcataattcctctggtgtctaaacagaagtgtgggaaatagaaagatgaatgggttatggtccccatcttccaggagtttacaaattcaacctaataaaggggaaaagatgccttcagtgacaatgtaagggagtgtctgagtccattttgcaacacaatagcagaacaccacaggctgggtaattaagaaatagtcaatgtttatttggctcatggttccagaggctgggaagtccaagatcgagggtccttcttgacgtgtcatgacatggtggaaggtgtcagtcacacggcaagagagagcacaggctcaaagttgcatcagcattaagcccttcgtgagggtggagcccttgtgactcaaacaacccccatatggccccacctctcagtgctgttgccttggggatgaagtttccaacatgtatttttgggggacacattcaaaccatagcagggagaatgtggtaagttccataaacaagttctaaggcctaaaaatgtagatgcccccatttataaacctggctgtgagttgagggtgatccaaatctttttatttatatttttgagacagagtctcgctctgttgcccaggctagagtgcagtggcgtgatctctgctcactgtaatctctgcctcccaggttcagatgattctcctgcctcagcctcccatgtagctgtgattacaggcgcccgccaccacgcctggctaatttttgtatttttagtagagatggggtttcaccatgttggccaggctggtctcgaactcccgacctcgtgatctgcccgcctcggcctcccagagtgctgggattacaggcgtgggtcaccatgcccagcccagattcattttttgaaatatggttttagtaatattttagtaacattagttatatctgtttttttttttcctgtgggctagggcacagtccccagaaatctgtggattagggccaaggatagacgaaggaacctgaaaccaggatgtcaaacgctgttgcagcagatgatcaatttgggcttcataaaaactggaatgtgctgaagttagcagaggtctggctcaatggacatgtcagacgtcagaggccacgtcgatgttaaaggtcatgggccacaaaacgcagggtccaagcctaagcccagagtaacaccgggtttcctgacccctctgaagataacgctgttggccccgctaactaatgagggtgtttgtgatgaaaaggcgacagtggccaggactgtgctgactgtggggtgccggggctgcggggagagagggacctcaccagctgtgtgtttgtcatgggcgtagacagctcaggacagcacagaacagcacagctctgaggcggtggacaagataaacacctactgtggggccaggccccaccaggagccctgggagtgaggcttatggaacactgacacacactcagtgtagatgcacaggctgtgatgaatgaccccaggtggggcctccacccagggctgccttgcacgctgaggcccgagagggctgcctgggagccatgcagggtcaggccgggagtggacgggggacctgctaggtcctcgcggctcagcacccgcctgcctgtggtccacacagtgccagtttccttgggagaatgggtccttccagccgtgtgtctgtgtctgtcctgctgggagtgcccgtggggcaaggccgggctgagggccccgctcggctgtcggcgtctcccacggtggtgctcagcggaacgtcccaaggacagaaggcggtggtgctgattcacttccgaggcacaatcagaaacccaggtcctgcctggactctgaggcccccaaggcctgggctggtttctctgccctcatttccccacctctgtgcggctcctgggtcatctcaaagacacggtgcccgctcccccccgtttctcggttacacaattcgaaggcgatccgtattttcaagcagcttacagtctggtcggagacaccaagaacgcagcagacgcgatggaagaattagcaactgacagatatttgtatataagcagaaacaaactaaggaagaaaggaaacatgccatttacaggcatttctgcactaaccaggtgctgattagttacataatcgatgaaacggttgtttatgcgccaagtcgttcaaacatttgttaactggcacctactagataccaagacccggcgctgtgaagaaaacatggcaatgtcacacactgggagatgcctgccttctgggagagagttatgtctgctgcttaacatgagcaataaacaagtgacattttggtttagaatcatcaaccgatttatgtcaaacaagcaaaggaagcagccatggaaacagagctcaggccccttcccggcagtggctttgctgtttaggagagagaggcctcatggtggactcactcattattttaatttatccctgtttggagcataacgttgtttgaaaaagcagaaagggacttacgtgtagatgaattgaatacacagtgggttcttgtatgtgtgggttttgtgtgtgtgtgtgtgtgtgtgtgtgtgtatgagattttattttgtttctatctaaaaatctctctaaaaagacagtagaggcaaggaagatagagaaggagaaaaagaagaaggaggctgggtgtggtggctcacatctgtgattccagcacatcgggaggccaaggcaggaggattgattgaggccaggagttcaagaccagcctggctaacatagtgagaccccatctctataaaaaattttaaaaaatagctgggcatggtggcgcacacctgtagtcccaactacttaggaggctgaggtgggaggatcacttgagcccaggagtttgaggctgcagtgagccatgatcgcaccactgcactccagcctcgttgacagagccagaccctgtctcgataaacaggaggaaagaagaatgtggcacaagcctttgaggacaaaaggaacagaagaggagccgtgggagctgggtcagcagtgtccgcacatcctaccgaggaagccgaaggctggtggagctgcaggcaagcacatttgcagctcaaacccgagaggcacagaacgggagtgtcagcacccatgggtgtcgggcgaaggcaggcctgaaataaaaggcttgcgggagacagggcaagaagcctgctcctccacctctcacagaaggtgagtgacccccactgtggctgacgcctggagaaggtgtgttctctggaccacacagagagaggtaggtttctcctgggatggtttgagtctgaggccaccccctcacccccactgtggctgatgcctggagaaggtgtgttctctggaccacacagagagatatcgctcctgggatggtttgagtctgaggccaccccctcttccccacttggctctcagaacactggcagccaaaggattatcgtctccaagacaaggcgttcgaaccctttcctttgagggatctcattcatccacttggaaagccacaaagatcctaacaggaaggggtctccgatgaggcctcccccgggatcacggaacaatgtggccacacacagagctgcagtcagcctggtagtgcctgacttgctgggtggacagccccaaatcttcagactcctggggaaagcatccacggtcaagttcacacacaaacaggacaaacggaaagctattcggaggaaatgggcgcagcgcagggaggacacttcaaggaataaaaatgctagaatttacatccttagagagagaagtagacattgaacccatgaaacaagaacagaacaccttaaaaaggaacgtatgaaaggaaacaaaagcttgtgcaaaaaaattaaactatgagagcaaaaatgccaaccgcaaaagaaaggttggaagataaaatctttaaaaactctcagaaggtgaaaccacaagacaaagagatgaaaaataaaagaataaagatacatttttggttcagtgaggagctaaaacatttaaaagaaacgagttccagcctaagcaaagaatggacaagacccacaaagcatgccacgaaatcgcagaactctaggaaggaggaggctcagcccttgctgcggagagaatcggaagccagcctgacactgggccaggcggaggcaaccccggacttcagggggcaacagagggaggaatgccgggaattccgtgggcacaccatcttcattaagcttcctcacccagccatgatctcggctcactgcaacctccgcctcctgggctcaagcaattctcctgcttcagccttccaagtagctgggattacaggcgtgtgccaccatgccccattaattttttgtgtttttagtagaaacagggtttcaacatgttggccaggctggtctcgaactcccgacctcaggcgatccgcccgcctcagcctcccaaagtgctgggattacaggcaggagccaccgcgcccggccctgttttctatgttctagagcagtgtttttgatggactgtgttatcccctcatatgtgtggttctggctcaggaaatagtcaagcagaggcttctagaaatggataaaagattggattcaattcccactaagattccttctgtctccaagaccctataatccttatggcatgaaaacctcattaacatgaaacctggtaattggtaatttgtactaaccatactgagctcaagttggagtgtggcgttgagctgataaaaaggctttcccagcaagtaatgctgcttaagaacaaactgaggtcaaactttataaatgcaccatacaagcagtttgtgtgataattaaaatagttcttagagatagtttccaaagaatgtttttctacttagcaaccctttattagcatattttttggttactgaatacacttgacttttccctcattccacggccttccctccaattagcctaaattgatagggttttaccccatgtgagcatcttgactatcgccgcagaaagaagatgtgaatgagggtcctctaatctaaggaacaaagacaggtcactgaggacggagactgactcccacttggctgttgtcaataggattttcctgaaagctcagcctctgacaatttcacgtgctttgttgatggtatctcaaagagcgaacattccttgagccacaaagaagaacttggctgacggaatgaagtgatggcaacatcgggaggaaatgccatcttcttcagagtctggtagctgtgggcgtgagcgccttcgcgtatgatggcttcctgcgcgacagcaagcacatcctggggaaagggctagaaagagaataggcagttctatctaactgcaaatgcaatataaatcacaggatgctgtgtctgtggagaaagctgttatgatcttatgctttattcattgtgcattccccggaacaacagctattctccaagccctgtgaccttcggagtcggtagaacacatcttccgtgtgcccttgggccttggcaccgtatcttaagagagacttgggcagacaagtgcagactgagataaggtaaaacaccaggaactctgtcttatgaggaatagtggaaggaaatgggaataatttctggattggataggatttcaggcaaacacgaaagatcttttcaaatatttgggaggaaagtaaggggaaaaaatggttccttttacgaggtaggcagtgacaacctgtattgtgtcttcctccatttaccttcccggtttgttctcccatctcccaactccactccaagtgacggttcagactttgaattcagctgctgcgggtgttttccagaaagcttgatgacaagggctcttcttgacttttataaaagcttggaagaatgtagtggtagggtagatagaggagtgatgtgtttaagaattaggagaaaaggctcggcacggtggctcacacctgtagtcccagcactttgggaggcagaggtggatagattacttgaggccaggagtttgagaccagcctggccaacatggcaaaatcctgtgtctactaaaaatacagaaattagccaggcgtggtggcacacgcctgtagtcccagttactcaggagactaaggcacaagaattgcttgaaccaggaggcagaggctgcagtgagccaagattgcgtcattgcactccagccggaacagcacagcaagactctgtctcaaaaaaaaataaaagaaaattaggagaaaaagaactgctctgggaagaagggaatggaactatcccaagattagaggaaggctgactcccattttatggagatgtccaaaagagaggacctcacatgcagctgacgggagttcgtgacctgcatgcccacatggaaggtaagggaccgtgagcattttggcagtcatgagcccacatggaaggcaagggaccgtaagcatttcagcagtcatgagcccggactgacgcctgcaggaggtccctgggtgctaggctctgccacaactccggtgacctctttgttgtcccagggccgtcgggcagtgactgggaactaataacgactgagatgaagtgtcgacacaatgctgatggaaggaggcttagacatgaatggaaattgacttaaagaaattactttcttgcatgcctatacttatggattcgatgactatacatttatacagctcaaggacagatcaaggaccaatgagtagaaggttctggaaggaaggtttagttactgcaaaaagaaatgtctaagcattgtcactcccagcagtaggagagtgcttttggaagccggagctcctgccacagggcagaacactaacacccatctttcaggggcgttttaagggaaaattccatgatgggtgtcacacactggattaagcaatatcttccacccctcccaaatctggggttctgtcattctatgaattatcagaatccctggctcacaagtgggactggactgagtctctaagagcttgtaaatatttgcacagccgtcctttgaaagcactcatcgggacttctgtgccataacactctgccctgagtgaccactgaagtgtttattttactctggatcctcgaatgggtgactgaattcatttgcaaacagggaaaattcagccgtgtcagctttgattgctctcaaggtcagaggtgttgttttctttcttgatgtgtaaggaatgtgtttttttcttcttatggtaactgtaagaccggactgagcataaagagagaagacatttgaagtacatgttgcaagcagagccagagggattaggggcaaaggaaatggaaggcagagactgagaagagacagtggaagtactaaggttacttcccagcccagctgagcgttttatgatggatgtgtcagggctccaagcggtggccttggctccactgccctgagattgctctgctgcgtgtcagaggacatcatcagtgtttgcaaaatccaattaaagcagcattagtgcacacgggcacactgagccgcccagcacgtttcatgcccagtccctctggcagttctgcaagcccagccgcagttttagaaaagagttatttgggtaagcctttggaacagaattttttcctccaatttaaatcatttttcattttattgaaaacttccagagctccatttggttctaatatcaaagcagggaaaagaaacttttccttcctttttgtgacatgcttataaaaattatttttgtcactcttaggtgaattattagcaagtatgacgtaatgctgctgagatgaagcacaaggacaggggagatgcaaggcaggaaggctgggctcccacccctcgctccttacatgtagaatgtggaactgaatcgcagctgttactgttacgtaatccagggatactaggaagtagaagtggcccaaactattttataacaatagtaggaaaaaacattttcctcaatttgtaaagatttctgattttgattatgtatcagtccataatctgcatgtacatccacagggtgaaattgttttgcataatctgttttcggccacggcagagttgcctgtactggaggaactctcctgctaataacgatgatagcttctgtattagatattaaaacaacagtttgaaggcactagagatcacccagaagctgacagaaactggaagggcaaaacccttgcaaggcgggaggcaaagtgaacaagcttagtgtagccacatgagtctatttgctgagggcgcttcccagttcacgcagggtgtgtgaagatagagttcaaatgagaagtgccaatgttctgagcgcggagtctgctagtgccccggagttcacgtgctggaagctgagttgctcttgtaaccgtgttggggcctttctgagattaggcctgaggctttgcccctgtggatggaatatgcttttgtgtcgggagtggattcgttgtcgagggaggtggctcctgataagttcattcccattcctctctctctctctttattttttttttgagacggagttttgcaattgttgcccaggctggagtagtgcagtagtgcaatctcagctcactgcaacctctgcctcccaggttcaagcgattcttctgcctcagcctcctgagtagctaggactacaggcatgtgtcaacacgcctgggtaatttttgtatttttagtagagacagggttttgccatgttggccagacttgtcttgaactcctgacctcaggtgatctgcctgcctcgacctcccaaagtgctgggattagaggcgtgagcaaccgcacccagcctctctctgtctcttgcacccacttccaccaggggaaggccctcaccagatgctggcaccatgctcttggacttcccagcctccagaaacatgagccaaaaaaacttctattccttatgtattacccagtctgtggaattgtggcaggacagtccacagctctcattctattctcagaggggtgacaggttccaaaggggttcatgtccactcatgtagaagccagaggaagacagatcacacagccacagcgtcagagttagaccaagaaaggggtgtttagagacttccaagcaatcatgaaacattccatttctatgtaagccgtttgactggtatgaagtatgcacttgctgagaatcaaacactgagaatatcaggcattctacattgagatctgatattgacaagtaaatgacataaggcagagaaaagtagttagaaaataaagaagatgcagccccaggtagccgcattctttcccctctccaaggccacacatgctgcccagcaggtcttggcattacagagaatgctggcagttctgtctgttgtttgtttggagggctcgctgctgagccacatcgagttttctggagacgcatcagctaagctactgaaaccatgctcagttcctccccgtgcagtaggcgttaccactgtgattctgtgggtgggacaaagaggcaaggaggctaatgggagaagtcgaggggcaagcacccactcagtgcccactcagctgctgaccctgtgctgcgggctgcctttcttgcagagagtaaaggagctctggtctggtgatggagggggatgtgctatgagagtcccacctgccaaagccctgatggaaatgggcccagactgctggagagtgcagcagggacaactcaccggggcagggggagctcgcagggtggctgggatagcacaacctcttcctcacacagggcatggcacaccccactcctataaaacaacaaccattcagttctcacttaaaaatccgaacgtgatccgcttttggtgaactttttttttttgagacggagtcttgctctgtcacccaggctggagtgcagtggcatgatcttagctcactgcaagctctgcctcccggggtcacaccattctcctgcctcagcctcccaagtagctgggactacaggcaccctccaccacacccggctgattttttgtatttttagtagagacggggtttcaccatgttagccaggatggtctcgatctcctgacctcgtggtctccctgcctcggcctcccaaagtgctgggattacaggtgtgagccactgcgcctggcctgttgaacttttaacatacttccctgtgctctagccacagccacactggttcccgttagctaaatttttaaccatacagtattgtcatttgcatgctgtagttaagagcttccagaggttacatgcactagatcttaacagcttagccctcatgaataacatgttatcttccaccatctcagggaagcagtgataccgtggagtgagaaaagtgcattctctcaggatttctgccgtgttttcatgctgaggtgtgacagagtatttccagtcccctaactctggtccatgaccttaagttaggtgggaataaccttaggaagtgccctttccccatgtggtcctttacaaccttcaaaactcccaaggatggacccaacttgacaaacatcaacagctccctgtgtcccaaaggtggacagtcggagaacctggggagtgagcctgcttctgcacagctaatcaaacatcacaccttttgtgcgaggtctgggagagctggtttggaatggcaaacactcgattcaacctccagacagcacggggtaaccaggaggggcagtggtcaaggtcccatgaggagtgactcagcaggtgctttgtctacatggctcgctcccacggaaacccagggcgggtgggaagggattttccccttgaggagtgttccctggggagtttgcctctttcccccattaactatttctccagacaatgctgagcttctgaaaccgcaacttcccagggagccttaccgtggcaaatgcgtctgagtgtttctcagagaggcctgggcacccacggcctgtgtgctctcagcttccttcattgttccgggcctcggtttccttatctataaattgggaatgtgaaaggctctcttgaagccttgctctcgggactagaaataactcacgtaaagcaaggggctgtggcgtgcacactgtcatctggaaagcactgctctgacctgggctgcttgtctcagaacacagaaatgaggccaggccactggtccgagctccctcgcccattaggccagactgtaatcggttctgtgtttacagaagttcaacaagatgtagtttacctcaaccgtgaaacacctgctaatacagacctcaagggtgctgtgaagattaaacagcttcacgctcatcgaaagcttggagctccacaacattcaacaaatgtcggctgtcactgttgcacagacgctcaagcctcccactctgccattcaagggtctggggacaggcatgagatgatagtgtgactgggaaagtagcggtgggggtggaagccagggcaggctcaggaggctcaagacctggcactgttcagtggctgggatggggtctggcctctgcaggccctgcctggctccttgtgtgtccactagtcaccaccacagcagatcaaaccagcacacagaaatgcctgtgcttcagaggaagtcacttacataaaaatttgatgtttaaaagggaaatacatacaagttactttcatgattttataggttctcagcagtcagaaaaagtagcacatctattaatgagaaatagtttacaatacagttctcagatgatgtgcttgtttgaattaattctcctgacggcatccacccgtggtgtcccgagcacacgtcctgatgcagcaatagtgacatgttgttttatttactaatgtccccacgtgtttagtacagggtctgccgcacagctggagctcagtaagcgtctgttgaattcagttgcgattcactaaacaccctgaggtgtactcctagaatttcttcttccagtcactggggcacaagccctgcctagattttcatatacaaaatgttaggtttgaagaaatggaagaaatgctgttttcttaggtgcagtcaaggagcgactttcaagggagctccactgcgtggcgaatcgtctgaatgcacacaggtctcttggggtggacgtgacagaagccaggcagtgtgaagtgggaaacacaataggaaggcaagaattgtggcccggcctagtacaaggtaggcctgtcgcgtaatgtgcagcccggcctagtagaaggtaggcctgtcacgtaatgtgtggacccagcctagtagaacgtaagcctgtcgtgcaacgtgtggacccggcctagtagaatgtaagcctctcgcgcaacgtgtggacccggcctagtagaaggtaggcctgtcacgtaatgtgtggacccagcctagtagaatgtaggcctgtcgtgcaacgtgtggacccggcctagtagaatgtaagcctgtcgtgcaacgtgtggacccggcctagtagaaggtaggcctgtcacgtaatgtgtggacccagcctagtagaatgtaggcctgtcgtgcaacgtgtggacccggcctagtagaatgtaagcctgtcgcgtaacgtgtggacccggcctagtagaatgtaagcctgtcgtgcaacgtgtggacccggcctagtagaaggtaggcctgtcgcgtaaggtgcggcccgccctagtagaaggtaggtgctgcgtaatgtgcggcccggcttagtagaatgtaggcctatcatgcaacgtgtggacccggcctagtagaatgtaagcctgtcacgtaacgtgtggacccggcctagtagaatgtaagcctgtcgtgcaacgtgtggacccggcctagtagaaggtaggcctgccgcgtaatgtgtggcccggcttagtagaatgtaggcctatcatgcaacgtgtggaccctgcctagtagaatgtaggcctgccgcgtaatgtgcggtccggcctagtagaaggtaggcctgtcgtgtaatgtgtggatccagcctagtagaaggtaggcctgttgcgtaatgtgcggcccggcctagtagaaggtaggtgccgcgtaatgtgtggccggcctagtagaaggtaggcctgccgtgtaatgtgtggcccggcttagtagaatgtaggcctatcatgcaacgtgtggaccctgcctagtagaatgtaggcctgtcacgtgatgtgtggcccggcctagtagaaggtaggcctgtcatgtaatgtgtggcctggcctagtagaaggtaggcctgtcgtgtaatgtgtggacctggcctagtagaatgtaggcctgtcatgtaatgtgtggacccggcctagtagaaggtaggcctgtcatgtaacgtgtggacccggcctagtagaaggtaggcctgttgtgcaacgtgtggacccaacctagtagaaggtaggcctgtcacgtaatgtgcagcccggcctagtagaaggtaggcctgttgtgtaatgtgtggacccggcctagtagaacataggcctgtcatgtaatgtgtggaactcgctttcttgtctgcaaaatgagacacttgaggaacagatctttcacttagcagagaggaatcagtggcatgagtttaaatcagtgagtctaccataaggtatttaaataatgctgaatttattttatttatttatttatttatttattatttttacagacagggtctggctctgtcgcccaggctggaatgcagtggtgtgatcacagctcactgtggcctctacttcctgggctcaaatgatcctcccacctcagcctcctgagtagctgggactacaggaacttgtcaccatgcacagctaattattttatcttttgtagagatgggatctcactgttgccctcttgaactcctgggctgaagagatcctcccagctgggcgctgtgatgcgtgcctgtattcccagctattcgggaggctgaggcaggagaatcacttgaacctgggaggtcaaggctgcagtgagccaagatagtgccactgcactccagcctgggtctgggctacaaagcaagatcctatctcagaaaaaaaaaaaaaagagagagagagagatcctcccgcttcagcctcccaaggtgttgggattataggcgtgagccaacgtgctggcctagagttctttttcttgttattattccctaaacaatatagtacaactatttatatatcatttacattgtattaggtattataaatcacctagagatgacaaagtacacaggaggattgcataggttatatgcaaatactatgccattttataccagggacttgagcatccactgatttgggtgtccacagggattcctggaaccaatgctccacccataccaagggatgactacatacaaagaccctgatgaaaggcaagggtggactgaggtcactgggtgtgggggtgggtgaggcaactctacccacactgccacactttaaaagtgagccccccgcctagggtgtgccagatgaactaccctatcccataggctatttctatagagttacaaacagaataatggggctgaagaatgaggccacacattcaggagccacctctaggctggaaacagtatttccactattcacttttcttcatcagtcttgccccaggtttgaccatttagtcttttccttatcaacttttgttttatacagcatgaatttctgctcattccttcattttatttgttcttttactttattttgctgttcttaaatttaagatggatgtttacctcgttaactttcaggtagaattttgtactcatgtacagagaaacgagtttctctttgtaagtcaattttcgcattctatatttcaaggttacgttattggtttacattaaagttatctttatgaattaaacatttattgtacttattaacacatttgggtttatagctaccatattatttgtggtttttccatttttttgtttcttttcacttttttcttgccttcatttcaattagcttttgttaaccattttagatttttttctactaatttggaagttatacattctgcttgtgtagttataatcattaacctaggaattataacagggatacttaatttaccaagtcttaagttcatcagtactttaccctagttctgaaagtaggacctagaactcttaactctatccctttcttgatttataggctttattaattatgtgttaaaatgtaataagatattactattgttttttatgcactttatttgttcctcattctgatcactttgcttctattgcaagtatattatttaaactttcttttacaaagggttggcttatggtaagatttctcagtgttcctttgtctgtaaatgtttttctcctcatccttaaaggatattttctctgggcatcgaattctagtttggcagcattgtttgtttcccaccccccctccttaatattgaagatattccactgtctcctgtctctcaatgttactgttgagcagtcagctgtcacactcactgttgctcttttgatggcaatctggcttttcctttcagttgcttttaacaaattgttcttggctttggtattctgcattctgtctatgatttcttatttatcattctggtactttatctttcctggaaaaatcttagtctttatatcttcaaccattgcctccttcccttgctccttctcctgtccttctggagtacttattggacaaacatttgctctcaatcctaccggtcttctcaatctatttcaatctgcttaagttcagtgttgtgtgttttccatttgcccctccagattgtgtcttcctctgccctgctctatgcccctggaagttgacttctacagactggatgtccaggccctcttgcattctggctgttgggttagtcaaagggaggccccagcagaattataaggaggagagactgctctggttattaatttctctcactccctttctgcagggctgagccttggtgtcactgtgttcctctatggctgtggctcccacctagggcccttctacatggttttagcatttgctaggttctatcattgccttaaccctcagtcctatgaattgtgatggcttcccacagttgccagttaactgggtcctttgtcatcctttgttggttcttttaacccagctaacacttctgttaatagtgtcttcagccagatgcggtggctgatgcctgtaatcccagcactttgggaggctgaggtgggtggatcacgaggtcaggagatagagaccatcctggctaacatggtgaaaccccgtctctactaaacatacaaaaaattagccaggtgtggtggtgggcacccgtagtcccagctactcgggaggctgaggcaggagaatggtgtgaacccaggaggcagagcttgcagtaagctgagatcgcaccactgtactccagcctgggtgacagagcgagactctgtctttacttccaagacacagtggagatataggcagcattgggtaaacattcccattccaaaagggagaaatcagccaaaagaaaggcactacaggccccaggcaaacaaaacctagcaggagtcattaaatcttaaggctccaaaataacctcctttgactccatgtctcacatccagggcacacggctgcaagggtggtctcccaaggccttgggcagctctgcccctgtggctttgcagggttcagccccctgggctgctctcaccagttggagttgaatgcttgtggcttttccaggtgtagggtgcaagctgctggtggatctaccattctggtttctggaggatgatggtccccttctcatagctccactaggcagtgccccagtggggactctgtgtgggggctccaacctcacatttccccttggcactgccatggcagaggttctctgtgagggctctctccctgcagcaggcttctctgtgcactcagaatttctcatacatcctctgaaatctaggtggaggccaccaagagttcttcatccttgcattctgtgcacctgcatgcttaacaccatgcaggagctgccaacggttatgttctccaaagtggcggtccaagctataactgggcccctttgaaccacggctgcagctaagcagctgaaatgtgggaagcagtgtcccaaggctgtgcagggcaatggataccctgggcctgacccgtgaaaccattctgccctcctaggcctctgggcctatgatgggaggggctcctgggaagatctctgaaatgccttcaagcctttttccccattattttggctcgcttttagttatgcaaatatccctagcaagtggtcattctgcagcctgctttagttcctctccttaaaaagctttttctttctgtgccacatggccaggctgcagattttccaaagttttatactctgcttcctgtttaaatgtaagttccaacattaggtcatttctttgctcccccatctgaggtaagctgttagaattagccaggctatctcttgaacactttgctgcttagtaatttcttctgtcagatgccctaaagcatcactttttagttcaaacttccacagatccccagggcacgactagaatgcagccaagctctttgctaaggcataacaagggtgacttttgatccagttcccaataatttcctcatttctatctgagacctcagcagcctggacttcactgtccatatcactatcagtatttcggtcacaaccactgaaccagtctctaagatgttctaagctttccctcatcatcctgtcttcctctgagccctccaaagtcttccaacctctgcctattacctagttccaaagttaattttatgttttcaggtatctttatagcaatgctccactcgttggtaccaattttctgtgatccaaacaccttgcacgaggccccacctccagcactggggattacaattcaatatgagatttgggtgggaaaaatatccaaactatatcactaagtaatatttagataactttaaagggtgtttaaaacatattttaggtactttgtactttttttttgtttcgttttgttttttgagatggagtctcactctgtcgcccagactggagtgcagtggtacgatctcggctcaccgcaacctctgctacccaggttcaagtgattctcctgctcagcttccagaatagctgggattacaggcgcctgccactgtgcccagctaatttttgtagttttagtagatatggggtttcatatcttggccaggctggtcttgaactcctgacctcatgatccacctgcctcggcctcccaaagtgctggattacaggcatgagccaccgcacccagccatgtactgttttcaatgagactgttctttatccctagctgaccatgtaaaagaaatggcacttgttttaaaatttgttattatgtgtggaacagataatgtctgaaattgcctgaatctagcagcaggcagcagggtaaacatgcttttagcatatatgtgctaatcaaagctattctttgattagctacttttttttttgatctgctacttcttcaacctatagcttttttttctttctttctttctttctttttttttttttttttgagatggaatcttactatgttgcccaggctggagtgcagtggcacaatcttggctcactgcaacctcctgcctcaagcaattttcctgcttcagcctacaggtgcgtgtaactatgcccaactaggttttgtatttttagtagagatggagttttgccatgttggccaggctggtctcgaactcctgacctccagtgatctgccaccttggcctcccaaagtgctgcgattacaggcgtgagacactgcgcccagcctcaacctataactttttatattttaaaaaataatttggactagaccacattttctcatggcagagtgggccagtcaagtaaaaagggaaaaaagagcaaattgtgatgagttgacaagatggaaaacactatctagataaagccacatatagcaggcaataacatattgcctcaaaatatgaaatcatgaagtttttacatatatacttctaaaatttactatttaaagttattaaaattctgtatgattcaattttctccaccaatcacatggccttcctagtactttcccattttgaatgtgtttcaacttctgtttacggagtattggcatggcagtctgccacagaaattttgaaaatgagaatagcttaaaataaaaaagtggtctgcattaatcccaatggaaagtgagctatgaagatgatcagctgaaacagactataaggcgaaaggaaacaggataggagttatttgctgggtagggatcattcacaagagttctttcatgttttcttaagagtttggaattcctactttgtcagtccccaggtatactgatgctttaatggagtttttaaatgaatgaacatttatgaaggaagacctgcattagtcaatattagcctgggacagaggaacagaagaggggttattacctttctctttatgtattggtcataggttcggattttctaaacttaagtattttgacattattcgttgtagcatatttggattaattatcagttgagcacagatttaaagagcatcttctttagatgccaatgcagtaggcatcagtactgtttacagataactctgttattctcaactcactgtccagaaataggcccatgggagctgagacggaaacatttaattgtcaaattcattcccctttcctcagcatagctattgtcaacctttactccaggagtctgctccctcaatgaccatcctgaacagaggcccctgctgacctatggtgagtatcttaaccagcttgggctgccataacaaaataccagactgagtggcttaaacaacagaaaattttcttttcacagttttggagactggaaggtccagatcaggacaccagcatagttgggttctggtgcagcctcttcctggcttgtggaaagccgccttctctctgtgctcacatggtctctccttggtgcaagcatggggtcggggaagcctgggagcagctctctggtgtcttttctcataagtgtgctaattccatcaggagagctccagcctcgtgaccttttctgaaccgaattacctccccaaggctccatctccaaacaccttaacactgggagacagggctttcacgtatgaatttggggagacttaatttggtccacagcagtgggcgtggagcatcagagagaaataactgatgctgagatttggagactatttgttatcacaggataatttagactgtccagacacatacattctgatagtgaatactattatttttatacttctatgcttttgtgaggaaataatatgtttttaattaaaaataatagcaggaaaggcacttagcttactattagtctagaagttggtggcagggctggaattgaaattttaagcctcctccctctggaaaacggaaattgctaaagcattatggtttccttgtgcagaccttcaaaatcaattattaaacttgtgacaatgacgtcacatcatcaaagtgaatttttttcactgtttttaacctgagggtcagacatcacaaccacctgcttaaccagcttccagaaacactaaggattcagatgtctgttgcaacatgaaacttgtctttgcttatctcgagtatctttttgggtacagcacagaatgctaatcttaagaaattctgcctgcagatatttagaatcatttggaaattgatcatacaagcataagtacatgcattccaaatacgtgtatgattattatcacaaatcttctctaggaaaagagatcgcaagatttccattaaacctaaaattgttcctttatggaacagcagaatgcaaagaatgtttttaacagtgtgtcaatagaatgactcgtactcaacccatagaaacaccccttatcagcagctctgacgtgagcaagggcagaagttcattagcacaggtgcctgtcatgatccacgcacaggaacggaattctcacagaagaaacacaacctgtctgcatatgcaaacagtgctttagtgaaacacaggtgctgggggattattgacagcatatgaccccaagtgcaatccatcatgtacctccatttaaataccaaacaattcatgaccagcctggacaacatggcgaaatctcccctctactaaaaaatacaaaaagtagccaggtgtggtggcatgtacctgtagtcccagctactcgggaggctgaggcacttaaatctgagaattgcttaaacctgggaggtggaggttgcagtgagccaagatcacaccattgcactccagcctaggcgacagagtgagaccctgtctcataaataaataaacaaacaaacaaataccaaacaaggtaataactctacagaggtcaagaacaaagccactctcggctggcagtgcaaaaggagagtggctttggagttccatgcgccctgaacgcacctcattgtgtctctccagctgtgtgacggtgagcaagcactcaaccacctcaaagccagcactcttgtctgtgaaacagagacaatcacacccacctcactatgctgtcccgagaagaaagcaagtgacctggcacatggtggaggctccctgcattgcagttgttaaggttcaacgataatttaatgaatagaacaaaagtttagcaaatattattgtaactaagcagctaataagaacatagataatacataatgcataattaataatacacaatctctttgctcacttattaatgcctgtagaatagggttagtgaaaagctaaaataattcacataaagtatttttaacatgcctggtagatagtaagtgagcaaagagtgaagaaacagaggcttggggaagctgagacattttcccaggatcacagcgggtggagctgtatctcagaaatgaagctcacagtcttaactcactgtgtaattctgcagagaatgtcaggctgcacctttggcccggagggtggctctcatgccattgctgccttccacctaaggaggtgtttccttagacctccctgttgacagctttcctctttatggcacagtgtggagttctgacccacttcagggttgtgcagagggggtctgacagtactgtaattcagtaggactacttgagtattgcagaagcttgattccaaccgctacagcccctacatcaggaacttactcaagccaacattcaatcaacggagttccacagtcactgtgaatgctcttggcagtgctgcctgaggtgagggatggcaaaaaagtaagacacagttcctgtccacgaagagctggctacttcttttggaaacaagatgtacacaaggaagcatctaggtacaaagcagcatgtgactcgttctgaatgagttcctgtggggatccagggaagtggccgacgggcccaatggagcactcataggaccctctaagaccggatgcctactgatggctaatccccatgtaaaggctcctttcaggcaggaagttcagttctgcaaaatgtacctttcatccatcagaattacagcaacgagaaggtaaaacagaaaagaccaaacccacaaaataaaaaggtctgaaaaacaaagctttttactgagaagtgcctcgcagtcagaagctttgcagagtacccttgagagcatcctttactacagctgagaagtacctttctgtcacaaggtacacactcagaggcgtcctggcagctggaacctgctaatgcagtcaggaactggcaatgtgcctcgtactgcaggcagcatttgcgacactcctcagaaaaggcctttagagtttggcttccccagagaagcccagaagtgtatgataaagaagcttgctcctagtggtgtagaatacatacttgcccccaagaagctatactctgccacaaaatcacaagaacaggcaaggatgttgattctcatcaacacgcacatggtgtaagatgcttggtaccttatcattgttatagctctgggcccatgatgagtcattatggttgtgcattcacagacatgcctttgtagctgaacaagttaaaagcaggtggctcatgcctgtaatctctgcactttgggaggccaaggtgggtggatcacttgaggtcagggtttgagaccagcctggctaatatggtaaaaccctgtctctactaaaaatacaaaatattagccgggagtggtggcaggtgcctgtaatcccagctacttgggaggctgaggcaggagaatggcttgaaccctggaggcggaggttgcagtgagctgagatggcgccactgcgctccagcctgcgcgacagagtgagattccgtctcaaaaaaaaaaaaaaaattaaagaaaggatgtttgcccatctgaagcaaagtattgactggacttatctaaataccggattacaagaaaaagaggaactggctatatcagagtgagagaaagtgggagaggttgaggaaacatacaagaacctaaaagaaagggcaataagtatgagcatagctttgctaatctcggaaatggtggccagaactgtcctgtggtttagcaaatgatcatagccagcaaatcctaattaccctagaagcttcctttagaagtgccacaaagatgtaggaggtatgcttatccgccttgtgacacaaaaatggaagcatagttaatagatgagaaaagcatgacccagaatgattttcaatattggaatgctgggaatttatgagaggtattttcgcgtaagaataataggacttgtttaaaaggattggagagtggggggcatcccagatgcgtgagaagcagtatagctaatggttagaagcaggtttgctggagccaggctgcctgggttcaaagcccacctctgctgcctgttagcttgtcagctgcacaaccacggggtgctttcgagccttgtgtgcctttgtttccccatgcacttcatgaggctgttgcagaaattaaacgagttaatatatagtcagcagctctgaacactgcttgactgagtcagccctacctaacgtttaatttaagggatgtggccctgggttcccaaagggagcggccactctattcacaaacataaaagcagtaaaggctccatcctcatcaaccttctcctcagttggaccccacaggactgtctctcgcaactgttccctgggctctcctaaggcactgcgcggaaccagctgcacctcttttgccttagatcaggctttcccttctccgcccgttttgggatttaacaagcacgagaaagcagggctgcagggaagccgcgagggcctcctcaccacggcccgggatcaagtcccacgcgcgaggccggggtaggggcgtcatctgctccacacccagaggctgggcacgccccgcacgcgcggcttcctcctcctttgcggggctcgccgcgacccaggacccccagactcccggatcccctagaccctctggactcctaagccccgcaactcccaaatcccaagaccccggaccctccaaccctggcccagggcgcgtggctgggggcctgaacccgctccagaaacccgcagggcagtctgtcggaaacccccgctttactcagcaggaatttagtctccgcgctccccctaaaacccgggcgtcctctcctctgtaccctcgctcctgaggccctcacacgccctccgtggctgacctccaagccgggcgggtgcgctgtgcgacgcggaaagcgccgtagagcacgcagaacacgattggctgagctcccggaagtgacgtacctcaaccgcccgacagtggaagtcccacctgcgcccgacggcggaagttccgggagtgccaagtacccgcgtgcatacggctgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggttcgttgttctcgtgatttaacgtttcataatttttaagtcattctctttcactgttagatttgggaatacctgttccttttcagaccatagtaggcccagactaaatttttacagcgttggttggtgtggcaagaatgagtcaacaagtgttgagtattaggactttttttttttttttttttttttgagacatagtttttcgctcttgtttcccaggctggagcgcagtctcggctcactgcaacctccacctcccgcgttcaagcgattctcctgcttcagcctcccgagtaacagggattacagtcgtgcaccaccacacccagctaattttcgtatttttagtagagacggggtttcaccacgttggccaagctggcctcgaactcctgatcccgggtgatcctcccgccccggcctcccaaagtgctggaattacaggcgtgagccactgcgcccggccctagtattaggacttttaagaagtcacgtttttatgtagtgaacattcgatttgggtcgcaattacacagacattgacgggcaactggagcctcccagggactcctgcacgagagggagttactgaagtccctgcagagtgactgttttcccctcgtcagtgcctccttttcttcaggtctcaaggacgggatgagcttgccttggaaagctttgtgggagtctcgtattttaccttcatagcaaaagttgtttccccacttctctccaccatttcttatttcttcctgacagttgttctggcacatctcttgatcgattgtagtattttctttctttctttttgagatggagtctcgctctgttggccaggttggagcgcagtggtgtgatcctgactgcagccaccgcctcccaggttcaagtgattttcctgcctcagcctcccgagtagctgggactacaggcatgcgccaccaggcctggctaatttttgtattttcagtagaagtggagtttcaccatgttggccagactggtcttgaactcctaatctcaagtgattcacttgcctcagcctcccaaagtgttaggattacaggcatgagctactgtgcccagccagattgtagtattttcgagtgcaggagtcatgtcttatttgtatttttggtcaaccatctctcaggtttgttgaaggaatttgctctttggattatatgaactttgttcatgttattgacttatgtggagaactttagaatatattatacaccatccgtcttctgttctgtggagtgagatttatatttttagagaacagatgacttatctaaaaactgggtgatggtaattgtttggtgattggaagtaaaaaaaaaaaatcacatcgggaaagtgtggtattcagttcattctagaagatgttgagtgagtgcctgtcctgtgcatcgggtactgtgttacaaaaatgcattagataaaatacctgcctctttggaagtcattttcaagagaggtaagtcgaggccgggtgcggtggctctcgcctgtaatcccagcactttgggaggctgaggcgggcaaatcacgaggtcaggagatcgagaccatcctggctaacacggtgaaaccccgtctctactaaaaatacagaaaaattagccaggcgtggtggcgggcgcctgtagtcccagctgctggggaggctgaggcaggagaatggtgtgaactgaacccaggaggcagagcttgcagtgaaccgagatcgcgccactgcactccagcctgggcaacagagcaagactccatctcaaaaaaaaaaaaaaaaaaaagtggggtaagtcatatctcgtatgaccatactagaaataaaacattgttatcatggaggacacacatggattgggagaggagaagagtgtggttagctgtggtaagttggagagtcagggggaaccttatgaagtaggtaacctttgacttggtcccccttcaggatgtgcgaacggcattaggtgcagaagaacgtagagaagatcttgtgtgggcccagaggggagaccgtgtgtgcccctcatagtacttggcagactgttgtgaccacccgtttacttgtctcacttgtaggcccagaggggagacagtgtgtgccccttatagtacttggcagactgttgtgaccacccatttacttgtctcacttgtaggcccagaggggagactgggcgtgcccctcatagtacaatacttggcagactgtgttgtgcccacctgtttacttctgtcactggaccctgaattccgtgaaggaagggacagtatcttgttcattatcctcagcacccaagtatccctaacaacctttgtatgaaataatattgagttaatcaaattgttgaattaatcaaagtgttcaagaaaaaaggtcaagtaatattgtgtggctagatacattggatttaggaatcctggggatcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgcgtagctgggattacaggtgcataaccacgcctaatttttgtatttttagtagaaatggggtttcaccatgttggccaggctggtcttgaactcctgacctcaaatgatctacctgcctcagcctcccaaagtgctgggattacaggcgtgagccaccacgcctggcctgcctgtttctttagctgtagaaaagcaagagcagaaactgcctggcaaactaacaaagccttatgacaccatgtgtggggtaatgtggttgcaaggttaattgaggttgtgaagggcgtggggatcagcagtatagtctcaaagcctaaatctgccgttgccccagaatagtccctgaaggcaggtgtaggcagagagaaatgtttggcttctgtgacagtacttcatatttaaacaagttataatggctttttttttttaagccagagtatcacaatctcagctccctgcaacctccacctcccaggttcaagcgattctcctgcctcagcctcccaagtagctgggattacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagagtacctgggggtgaagaaagtgatttaagaatgagatttttgtttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttggcctcccaaagtgctgggattacagacataagccacagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagtcctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaaatgtagacgacatttaaatctatctgagatcaccttggaagggaatgtaggaagaagggtgctgtggggagcatgaatgtttggggtagagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccataggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcatgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctggagtgcagtggcatgatctcagtccactgcaaccttcacctcccaggttcaagtgattctcctgcctcagcctttcgagtagcagggattacaggtgcacaccaccacgaccggccaatttttgtgtttttttagtagagagggggtttcaccatgttggccaggctggtcttgaactcctgacttcaggtgatctgcccgccttggcctcccaaagtgctaggattacaggtgtgagtcacactgcacctggcaagagtcttgtctttaaacagaacaaatatcttggtttatcaagaacttgaaatttctccatcatcataaagaaaactcatctgagctcttgggatgcataagaacaggtcgcatgtctctgatataattcaggggaggcagccagctgccagtgtggatttctgcattttcttaacataaaatgaaattatctttgtgtcatttctaactctgttatcagaaatggcatatatacagtttaaaagcgtgaagcaggctgggcacagtgattcacgcctgtaatcccaacactttgggaggccaaggcaggcagctaacctgaggtcagaagttcgagattggcctggccaacatggcgaaaccccatctctactaaaaatacaaaaattagctggacgtggtggtgggtgcctgtaatcccagctacttggaaggctgaggctggagaatcgcttgaacccagaagacaggggttgcagtgagccgagattgtgccattgcactccagcctgggcgacaggagcgaaactctgtctcaaaaaaaataaataaatacaaagcaagaagcaatgtttccacactctaattttgtaaattgtgaagaaagtaattcctaagacatgggagggttctcagttatcccagtttttgtgttttatgatgtcgctggtaaaaagaggagtcatttctctcaacatcatggctagcatttctttgagctctacagggttcctcctcccttttttgatgtttaaatagtatgtacttttctgtcactggtttattttgtggtattcagtttgggagacctacttttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttcttttttttcttcaacactttgaatatatatcatcccattgtctcctggcgtgcaaggtttctgcaaagaaatctgctgttagtctaatggggattttcttatatgtgacttcaagcttttctctagctgtttttagaatttcctttatatttgacttttgacagtttgactataatgtgccttggggaagacctttctgggctgactctatttgggaattcttgaacttcctggttttagatgtctatacctctccccagtcttggaaagttttcagctatctcattaaataggttactaagccttttcccttctcttctccttcttgaactcccataatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcaggtttactctctgtggtggatctctgatcctgaagcacccctagcagcttaagcccacagggcaaggctgtggctgtggctccacccgtggggtcagggcacagtcctggcctgactccagggaagacgcactctggaggtttgagcctgggaagcagggtagagctgtacttcagaaacctgagccagtagggagggcttagtgtcagctcaaggggaactctggaccctgggatggtggggcccagcagtatcccagactctctgatgctaggtgaggtggcagcaaggaccccagaatggactagtccagctgtcatttgggccctagaggacagggaggaggacagcagtgactccatttcctggaaagagtggtgactctgcagctcagaatatagggttagtccagctccagggagcaggtgctggagctgtttgcgtggtggggcaggtgcctcggctcagcccctgccctgtttccctggggtgtggagtacaatgtcagctcctccccatggtatgtggctggtcagcctgggcctgagggttgtgactcttctgggcgccccaggcaccgttgccctgggatacaaggtacctcttcagcatagacgctgggatatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagccgcagttccagtcccaagatgatggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggctaattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatcccagcactttgggaggctgaggcgggtagatcacccaaggtcgggagttcgagaccagcctggccaacgtggtgaaactccgtctctcctaaaaatacaaaattagccgggcgtggtagcgcatgcttgtaatcccagctactcgggaggctgaggcaggagaatcgtttgaacctgggaggcggaggttgctgtgagctgagatcatgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattagtttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtcttgtgtaaagatgattttattgttgtgtgtttatgtaatgctgggtgcggttgagcatgtttgtctgcttattggccttttcaaagttctttaggctgtttatctttttctcgctgatttgttacttttgtattacaaaggttggattcttgtcagatacattgcaaatttttttctctttttgtcacttgcctttttaacttcaaatgtgctgtacatttttgaactattaacatatattaatttttttttctgggtgttcaggtttgcattgtacatagaaaggcttaccattcattccaaagtcattttaaaagtatcttttcttgctgggtgcagtggctcacgtctgtaatcccagcactctgggaggccgaggcgggtggatcacctgaggtcaagagtctgagaccagcctggcaatcatggtgaaaccccatctctgctaaaactacgaaaattagtcgggcgcgcacctataattctacctattcaggaggctgaggcgggagaatcgtttgaacctgggaggtggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgataatttctctttctattgcaggaacgagatcttgagctggaaatgggagatgattatattttggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccacccacccaccccggacactctggtggagatgctgggccccttcgttatcctgcacccctccatcctgactctgcctcctgcacctcttccctgtcccgacactggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctggatgggctctgctgtgctgggcccttcattctcctgcatccctccatcctgactgtgcctcctgcacctcttccccccaccccgagactctggtggagatgctgggccccttcattctcctgcatccctccatcctgactgtgccccctgcaccaccttccccaccctgtatctccgccaggcccttaatggactctgctgtgctggaccctcttccttgggggctccgctgtgtcacatctttttcctgcctcaatcccctccctacttgctttttcttagcatataaaagtccacaagttttactcatctttttaaaaaacgaaaacatccttagaccgtgtcctccattagttgctatcctgccttcttctctcagctgagctgtctgaaacatgctaacatgcttatacaatacttgctgtcctgccttctgctctcagctgagctctctggaacatgctttttatacaatacttgctgtcctgccttcttctctcagctgagctctctggaacattctttttatacaatacttgccatctgcatgtcccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttttagtggagatggggtttcaccatgttggccaggctggtctcaaactccttacctcaagtgatctgcctgccttggcctcccaaagtgctgagattacaggcgtgagccaccacgcccggctggttttcttgttctttaatttctgcattaaatctggactctttaggccgggcgcagtggctcacgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagattcgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctgatggttgtccctttgtgttcatatcagtaacccccaaaatggggcagtgagggagagagcattgtttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagtggacctggggtcctgagcgctgagcctgggagtggacctggggtcctgagcgctgagcctgggagtggggctggggtcctgagcgctgagcctgggagtggggctggggtcctgagctctgagcctgggagcggggctggggtcctgagcgctgagcctgggagcggggctggggtcctgagcgctgagcctgggagcggggctggggtcctgagcgctgagcctgggagtggacctggggtcctgagcgctgagcactgagcctgggagtggacctggggtcctgagcgctgagcactgagcctgggagtggacctggggtcctgagcgctgagcattgcttcccctgctttgcaggcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaaggtcagtctctgtgttgtgtaatgtaataaaatgacagtctctgttgtttattgcacagggttcagggcaaacaccagcagttgccatttgcaggaactatggcaggggttgtgtgtactgcatgccctcgttttgtggcatcctttagaggagagcacgggtcagggtgcaggtggatgcccctgacagctgccctggatggacccctccttggcactttgcttttgcggagggtggccagagcatggtctgacagcactagcagtctgggcttagaccctgctgtctgaagagggccaggaagtggccacagctgagcaccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccattgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctccgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaacactttctttggtaattgataatttccaaaacctcgattttagctaagtaaatttttgtggactcaagtctgaatgataaaccggctttggtttcttggttccagtaaacctgtctgtcttcatttaaagaactaaccgtgtcacacacacatcctcaacagaaaaccccgtagaaaccggctagcgttgtcaggagaacatccatcctctcttaaacgtgttcttgagtggatgaaggtaacacatgctcacaggatcctggacattctttctacacttgaatttctttcttttttttttttttgagatggagtctcgctctgtcgccaggctggagtgcagtggcacaatcccggctcactgcaacctctgactcccaagtagctgggattacaggcgtgtgccactacgcccagctaatttttgtacttttaatagagacggggtttcaccatgttggccaggatggtcttgatttcttgaccttgtgatccgcccgcctcggcctcccaaagtgatgggattacaggcgtgagccaccacgcccggcttgaatttcctcttcggtgtgtggtcgacagattcctgcacagtctcaaccctgcctgggacacatagggactcacactgccccatccacagctacattcacagccccattcacagccccattcacagctcattcacagccccatccacagccccatccttcatcctcatggtgcttcatgaggtcaatggtgtagatccagcctggactttgttcaccgtctgcccgctgccaacctggactcccgtggacacagctgagactggatgctgtgtgtacctgctccccaggaattcccagctctgcttgcagacgcctctgggctgccctcctcactccgatggcatccttttcttccagttctgctgggttgtataatgggtggctactacaggagtcggtaaaataccctggaaaaaatgcatgtgggaacatccctctttattcctgaaaagtgaatatattaaatacaaatgcagatgcttcatgtaaaaccatcatccgtcatcagcagaagacagcctggcggggggagtgggtttgtcatgggctctcagagcagcactcgcctccagcctccacggctgtgggcttggtgagggtcttccacatgaccacctggcggggctggccctgaccgctcctgcggcccttcctgcagatgtgcacacacatgtcccgtggcactatcccagtatgtcttaggagagggactggttcctactcagttttgtacccacagaggacctgagatgccatggggtggcgggaggaggtggtggggctgtgggctgggtggctgcaccagctgggctgaggaagctgggctgcactttgagggtggtgatcagtgagcatggtttcacaggaagactgctggaatacctttgaccaagtttccttactgagaggttctacttaatttacccaagtaacagcaatagcgctatgacgggaggtcacactctcctcagtaaatctctgttccctctcgttcctcagaccctcagtgcttccttcggtcactctgcaaggagtttggctgaagttgaatccactcttgcaagtacaagagctggtactcccacctgcccctatgtatcctggaggcggctaacacatgataggaaatcttagctccaggggctttatttgcaaactgttgactatgtactacagttgaccctcttaactttgcagctcctgaatttttctgaaacaaactttgcattcagctccatcaaggagcccgtgagtacaacttgaccagcaagtatggtggtgggtttgggaatgggcaggatgtacccactgcggctccgaggaagaactaagggaggagaaaacctcggccacagctggccgtgcttagccattcgctttaatggctcaggcaaggtctggttttgaaaatttgaggacagcctaggccaaaacactttaaatgaccacaattgacgtaaatgctgttcccctctaaaaaattttttggccgggcccggtggctcacgcctataatcccagcactttggaaggccaagacaggcatatcacgaggtcaggagatcgagaccatcctggctaacacggtgaaaccccgtctctactaaaaatacaaaacgttacccgggtgtggtggcgggcgcctgtagtcccagctacttgggaggctgaggcaggacaatggcgtgaacccaggaggcggggcttgcagtgagccgagatggcgccactgcactccagcctgggtgactgagccagactccatctccaaaaaaaaaaaaaaattttaagttgtaattttaagaagtacaagataattaaaactctaagacctgtaagataatttttattattattacctagttaattttatgctaaatgctattttaatcccctaaatccttaggttgataaattcctctgcatttaagtaacttgccgttgcaaagaaacaacaaaacaaaaaaacccagaaactcatatagtttcttacttttttaaaaaagaaaacccagcctactgaagagctatcagcataattagcatctgcctaagctgccgattttctgcaggatgagctgccagctcaccacagtgcggcactgagcaccagagagttcctgtcccagattcctccggtcaagtcacatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactcaatgtgcaagttgaaccagggcccttttataccctggggatgtagaaagatatcagctaaggcaatctgatatttttgtattcttaacaagaaaacacaccccggtctctctctatctctccatctctttctctctatctttctccctctcaattgagggataatagaaaattgttttgacacaatctcactttaaaaaatgcttttagtttttaaacctagggtaagttattttctactctatggctttctttttttttttttttttaaggtgatgtctagctctgttgcccaggccagagtgcagtggcgtgatctcggctgactgcaacctctgcctcccgggttcgggcgattctcctgcctcagcatcccgagtagctgagattacaggcgcccgccatcacgcccagctaatttttttgtatttttagtagagacgaggtttcaccatgttggccaggctggtctccatctcctgacctcaggtgatccgcccgcctcggcctcccaaagtgctgggattacaggtgtgagccacggcgccgttcgatggcatctttttaattcacttgctgtatatatcatcccagattttaaaaagaaaaaataaaggtggcaaatggaagagaaaaataataaacattgtgactaaaattactgaataaattcttaggatagctgaaaatcgataaataaatgcaagaccttggaaaccaatgtgtttggaagagctaaaaaactgtataatttcttgcctatcatattccaaatatcatctaccaactaaagctctaggccaaatagttttgcaagtagggtctcttaaaatatcaaaaaaatgtttgccatatctgtcggttctctcagggaatatgaggagagaagcacgatggacgcatgactccgctgactttggcacggataatacagaacaaaaataacacagcagcagtgatgggtaatattctataaaaagattaatgtgttttgctcttttgtctttccataagttcacctttatgcatgtaatttttagttacgtagaaaatcaaaaggctatgcctgaaatgttttccctggaaatcagttctgagactcaggaataaatggtctgtttgaaacttgtttcttttgcagtcagaagagtaagaatgggagaatgatactcttttaaagatctaaaaaataataaataagtctatgaattaggctttgaggaagaaactaatatacaataccgtacctattataatccaacaactctaatagtaataataataatagtaagacagccagacacacattgtgtccttcctttgtgccagtttctattttaagagtttaatgtatattaattcatttgatcctcacgacagctttctgagataagcgttattttttattatcacagcatcgataaggaactgaagcacagagaggtaaattacctgcccaaggcaatgtggctgcagatgcagctgagcccccagaatctgtgcagtttaacatgttgggatcgtcaccaccaaactaagcactgaaagctttagaggcaaatgttatcaaaatttcaaggaaggaattgtcattctctgtaaaatgttctaggggataaaaaaggagggaaaccctttgctaggttgatctgggtacaaggttctgacacataaagcacacaaaaaacattataaaggaaaggaaggaagacattttgattaggctatatgcggagaattttcttaagagaggttatgacaactttaagaatgacagttgatgacctataatgctgcaggtaggaggttaagaataaactctaggaatagatgattacatctgattaaggcaaattagaagcaacagaaagggctctagatatcagtgaaatatagagaaggacatggaggccaagactgggaaaagcaggtaaaaagaaatggaagtggaaagagttaaaaaggagtaggccaagtattgtaggtatgaaagagagggtaaaacaaatacagcatgtgctaaaaggggtatccttgaacaagagagccataataataaagaaaaatatcccagacacacaagatgacttaaacccacagatggaaagggcttgccatgttccagaaatactgacacattatcgtcgacactggggtaaacttctcagatctctgagaaaactgctgcatgcagaagagaacagccactcccaacaccatcactccatctcctaggcattgtacaaccctaatcctctgctttccacctagaatgatgggtgatccatgtacttaccaaaagtcacttcttgggtcaggtgtggtggctcatgcctgtaatcccagcactttgggaggctgaggcgggtggatcacctgaggtcaggagtttgagatgagcctggtcaacatggtgaaaccccatctttactaaaaatagaaaaaagggccgggtgcggtggcttatgcctgtagtcccagcactttgggaggccaaggcaggtggatcacgaggtgaggagatcgagaccatcctggctaacacggtgaaaccccgtctctactaaaaatacaaaaaaattagccgggtgtggtggtgggcgcctgtagtcccagctactcaggaggctgaagcaggagaatggtgtgaactcgggaggccgagcttgccgtgagcagagatcgctccattgcactccagcctgggcaacagagcgagactctgtctcaaaaacaaacaaaaaacaaaaaataacttcttctgcagcagattcacccacagtcacctactcaaagacatcgtccagcaattttccctttttcttctctatcatcacgttttctctctctctgttggaattctcctatcagtctgcaagcatgtgactatgatttcatttaagtaacagctagttttttagacctcatttgcccagcaagctactcctttgcaggaacactcttagaaaacttccttcatgctcactatatccagttcctttctctaatatttctcgttccttttctcacgtttaaaactatcaagtaacttaacctaaattgttaagtacaattgttgagctgttcaaattttcaactcctgtcaacaaaattccaaagaacaagcttctaagataagcacttcctgatatttgataacataggttaaaatttctgtaaatatcttaagagattatactcaaatccatatgttggaaaacggtgatgaataaaattttggcagtgaggaaaataaaaataactttccataatagggttatttttatctatataaatcaagaaagaattaacactttagcaatgatcagaaaagatgaggcccttggtattactgggaaaatttggaagagataattaatttgggagagcttctagaacaagtactcagaagtgttcaataataagtaaaatgacacatatgtaattgatgtcttaaggctgatgacagcagccctcctaaatgaatctgcagtttgctactaaatccatacaattcgcctcctctaatatatacgtattttgagacggagtctccctctgtctccaggctggagtgcaatggcatgatctcggctcactgcaacatccgcctcctgggttcaagcaattctcctgcctcagcctctcgagtagctgggactacaggtgcacgctgccacccctggttaattttttttttgtattttagtagagatggggtttcaccactttgcccaggctggtctcaaactcctgagctcaggcaatccgcctgccttggcctcccaaaatgttaggattacaggcgtgagccactgcgcctggacctcctccaatatttggccaagccacgcaatctttaagctcccatgtctgtccatgattgtaggtttataatttggaacttcggttatttaattaattaaaaatattcagatatatcctgcaaataaatacaaagtttttgtactcagcatctttagtgcactttcccacaaggagttgtatgtaaatgaaaaaaatagataaatgcaagcatgtaaatcaactcctattattaaccatttacttagctcaagtttatttacacctgaatgaaaagttccatttgcatcaaaaatacattcgtatactcttaaggcagtgtccggcgcagcggctcacgcctgtaatcctagcactttgggaggctgaggcgggtggattacttgggcccaggcatccagcctggacaacaatggcaagagccatctctacaaaaaatacaaaaacttagccaggcatggtggtgtgcacctgtagtcccagctactctggaggctgagatgggagaatcgcctgagcctcagaggtcaaggctgcagtgagctgggattgagccactgtactccagcctggattacatatatttgtatattcctaaggcacataatggacctaggtcaccaaaactaaaagatattctagaccaaaattttgaatgtaatttaataaccttgtacaaaccctctacagctgcacattaccaaagctagtatcactgtacctagtggcttactgcctcattcaattgaaaagatcaaactaattcaatcctgctctccaaagaacactttttctgaatgggctctcagacttttcctgaatgggctctcagattctgctttcctaagaaagtgtgttgaggtagttctttttctgaatgggctctcagattctgctctcctaagaaagagtgttgaggtagttctttttctgaatgggctctcagattctgctttcctaagaaagtgtgttgagctgtagttctacagcattgttcaatgcaaagatagggttggctgtaggttttcagaaggtgacctttatcaggttgaagaagttcccttctcgtcttactttcttgagattttatcatgaattgatgttgagttttgtcaaatgttttttctgcatttctactgaaatgagtcttgtgtggtcttttcccctttattctagcaatatggtgtatcatattaattgattttcagatgttaaactagccttgctttcttgaaataaatcccacttgggcatggagaatattctttttatatgttgctggtttctgttaatattttaagatttttgtatctggattcgtgattgataatagttattcttgtaatatctattataaatagttactgtgtggcttggccaaatactggaggaggtgaattgtatggattcagtagcaaattgcagattcatttgagagggctgctgtcatcagccttaagatatcaatcacactgggcgcagtggctcacacctgtaatcccagcactttgggtggccgaggtgggtggatcacaaggtcaggagttcaagaccagcctggccaacatggtgaaaccacatctctactaaaaatacaaaaattagccaggcatggtggcaggcacctgtaatcccagctactcgggaggctgaggcagagaattgcttgaactgaggaggtggaggttgcagtgagctgagatcgtgccattacactccagcctgggcaacagagcaagacaatgactcaaaaaaaaaaaatatcaatcacatatgtgtcattttacttattactgaacatttctcaatagaaatctttttgctatatttgagatatcccgttttcttctgcatatgcttttgggaggtaggataactaaaaatattatatataaaatataaaataacaatatataaaataactaatatgataactaatataactatatatagctatatatacctacatataactgcaatataaccataatatataaaataattaatataacatatagattagttataaaataatatatataaaactaataaaataacaccaatatataaaaaatataaaataactaaaatacattggtatagtttcttgtaataaccaaaagaaagtgttcctttttcctctatttcttggaagtgcttatgaaggactggtaatatttcttattttttattatttttgagacagagtttcgctcttgttgtccaggctggagtgcaatggcgcgatctcggctcactgcaacctccgcctcccagtttcaagtgattctcctgcctcagcctcctgggtagctggaattacaggcgtgtgccaccacacccggctaattttgtatttttagtagagacggggtttcaccgtgttggtcaggctggtcttgaactcctgacctcaggtgatccgcccgcttcagcctcctgaagtgttgggattacaggcgtgagccaccatgctcggccaatacttcttctttaaatgtttggtagaactcactagtgaggccactgggccttgtcttttcttcatgggaagattttaattactatgccttagctgggtaatacaaagatgtacctgcattatttcggattttcatcatttgtgcattctctctgttcttcttgatcattctagttaatggctttttccaactttgttgctcctttttttttttttttttttttttgagacagtctcactctgttgcccagggtgaagtgcagtggtgcgatcttggctcaccgcaacctctgcctcccgggttcaagcaattcttgtccctcagccccctccccctgcctgtccctccttcctcctgctgagtagctgcgattacaggcacacaccaccatgcccggctaatttttgtagagatggggtttcaccatgtcacccaggctgctctcaaactcctagcctcaagtgatctgccaatcttggcctcccaaagtgctgggatcactagaagcttttcaatttttttattccaaagcaatctgatgcagtttttgctatatttgagatatctcattttcttctgcatatgctattgggagataggaaagattttggaaaatgtgtaagaaaaaggaagatactaaaaacatactaagattgtatgtagggaaaggttacaactctaactttgataatgtgcattaaatcgacaaatccttgaaaagcacagctcgataaatccaacaaaaggagaaaaagaacatgtgaagagttgaatatatgtgaaagaaatgtaagttcatttttctttttttttttgagatggagtctcgctctgtcgcccaggctggagtgcagtggggcgatctcggctcactgcaagctccgcctcccgggttcacgccattctcctgcctcagcctcccgagtagctgggactacaggcgcctgacactccgcctggctaaatttttgtattttttagtagagacggggtttcaccgtgttagccaggatggtctcgatctcctgaccttgtgatctgcccgcctcggcctcccaaagtgctgggattacaggcgtgagccgccgcacccggtcgtaagttcattattaaaatgggccccatatccacgtgaataggggtcagtctcagacttagctttaattttcagccatgagaagactactgctcttcctccaacactcacttctctattttctctatcgtttgatcctgtctcctgtacaactgggtggtatttaaccatgtttaggctcaggtataacccaagctctgaaactgtaatagaaaattaagtaaatgaaaggcaaaaaatgaaagacttaataaggtttaagctgttattcatctaggaggctgaataacaatacatatacatgtttttgttgtttatgtgtatatattttttatgaatagagttgttcctattatgttgtatcttgtaataattactaatgacaaggttcataaatagctagatgttaacataactggccaaactccagtgacaagggccctgttacaatcagtaggaccaacctgctaagacctgagctcagagctcagggatggccaaggtcaaggcccagtggttgtgacgagatgccaggaaaccttacccactgcatgcctgtgttgtgccatggtgctgtaagtagtctctttgggtacactgccagtaggcttttggcatacatgtatgggctagtattttcaggccaaaaaactatccctgtctcattgtttactatttttgtgcagcaatttggttttactgttggttcttactctggtcttgccccaagttcaatactttggttcttctcttctccctaaactttccctgtcctgattccctgagaacaattcccttttctctgaattgggatcctatttctaccccttgcatacatacccctcctaattcttctgggtaaatttctatgcccattaactctagacatacatttgtaaattactgagaccctaaattgagaattatgtttgccattacttttaaaagtgtaatctgaatcccagcactttgggaggccgaggcgggcggatcacgaggtcaggagatccagaccatccagactaacacggtgaaaccccgtctctactaaaaatacaaaaaaattagccgggcgtggtggcgggcgcctgtagtcccagctactcagaggctgaggcaggagaatggcgtgaacccgggaggcggagcttgcagtgagccgagatcgcaccactggactccagcctgggcgaaggagcgagactccgtctcaaaaaaaaaaaaaaaagtgtaatctgtttttttgcctcctgaaatcacttatgtataaacacattaaagtgggtcaccgtgtcacgtcttgggcttcctgggacaagaatcaaatggcacatgcctggccaaagtgctcagatcaatctgcaaaccatggtcacagagccagtcacagagtcttacggctttcattgtagcttctctgtggaatatcttcaaggacatgtgtgtgctttaggatgttcacgtgtcatgattaagttgtaaatttcaaaaattctaagaatgcctattgttggccagaagtataaaaattggaaagattttaataaaatcatctttcaatcttacttaaataggtctatgaagtctgcatctcttcctctggaaagtaacgtaagggctgtgaagaacattgtccataatgaaactgagaagggctgttctccctgggaacagaaaggtcactgtctttgctcaacaaacagcctaaagccaggaacgcaggcctccccaggcctcttggccgcctctcaagcttcctcaataaaaaattcacatggaagacattctagtctatcttctcttccttctttcttccctttagctaataattattgagtgctgattatgttctggacacagttctagaatttctgtgataagaaacagagaccccagcagtgattctctgctggggccgatggctctcagggacatccttcaaaacagggcccatttggttctttaaaaaaaataatgtccagtttctctaaaaattctgtcatgacttttatttctttgatgttaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtatgacaaagacatgggggttgtttggagtctgtgatg

SEQ ID NO: 84 - DNA, 194007 bp, Homo sapiens
cagacggtctgggtttggttattaggataactctattccttagaaacccttaaattgaaaacatggggttgggcatggtggctcacatctgtaatcccagcactttgggaagccatggtggaaggatcacttgaggccaggagttccagaccagcctgggcaacatagtgcaaccccatttctgttaaaaaatgtaaatattggccgggcacggtggctcttgcctgtaatcctagcactttgcactttgggaggcggaggcaggcagatcacgaggtcaggagatcgagaccatcctggctaacacggtgaaaccccatctctactaaaaatacaaaatattagccaggcttggtggcgggcgcctgtagtcccagctactcgggaggctgaggcaggagaatggcgtgaacccgggaggcggagcttgcagtgagccgagatcgtgccactgcatccagcctgcgcgacacagtgaacctctgtctcaaaaaaaaaaaaaaaaaaaaaagtaaatatttagccgggcatgatgctgtgcacctgtagttccagctactctggaggctgaggcaggagaataacttgaacccaggaggctgaggctgcagtgagctatgattgcaccgctgcactccagcctgagtgacagagcaagaccctgtctaaaaaaataaaacatagagtgttcacaatagaaaaatatagcaagaaagagagtagatttgtgattgtccacagctggggatttagaagtaaatgtgtagtgactgctaatgggtacagggtttatttttcagtgatgaaaatattttataatcaaatgtaagtgttccacaactttgtgaatatactaaaaaccactaaattgcataattggagtggattaattgtacatatgtgaattatatatcaataaagttgttattttaaaaaccaagaggatattgattgttcccaacacaaagaaatgataaatgtttcagatgatggatatgctaattacctaatttgctcactatacattatatgtgttgtaacatcactgtgtaccccatacatattacaatcattatgtgtcaatataaagtacttatttatttatttatttattattttttgagacagagtctcaccatgttgcccaggctggagtgccatagctggctaattttttttgtatttttagtagagacaaggttttgccatgttggccaggctggtcttgaacccctggcctcaagtgatccacctgccctggcctcccaaagtgctgggactgcatgcctgcaatttatgtatgcccagactagtctgggcaacatagtgagaccctatctctacaaaaaatttaaaaattagctgggcatggtggcatgtgcacccagtcaaaaaaaaatttttttaatcactgaatttgaagataggtcaattgagattatccagtctctctttccagaacaaaaagaaaaaaggtgaaaataaggaacagaatctcagagacctgtgggaaacctttaaacataccaatgatgcataacaacaaggggaggagagagagaaaaatagataaataaatttgaatccataatggccaaaaatttccaaaatttgctaagagaaaccaatctacatatccaggaagctcaaaaactaacagtaaggtaaattcaaaaggatacaaaatgtagacatataataatcaaactgctggaagtcaaagacaaaaagaaaatctgggccaggcatggtggctcatgcctgtaatcccagcactttgggaggccaaggcgggcggatcacctgaggtcgggagttcgagaccagcctgatcaacatggagaaaccccgtctctactaaaaatacaaaattacccgggcttggtgacacatacctgtaatcccggctactcgggaggctgaggcaggagagtcgcttgaactcgggaggcggaggttgtggtgagctgagatcatgtcattgcactccagccagggcaacaagagtgaaactccgtctcaaaaaaaaaaaaaaaaaaaaaaaaaagaaagaaagaaagaaagaaaaaagaaaagaaaatctggaaagcagcaagacagaagcaactcatcacatacaagagatcttcaataaaattaacagctaatttatcagaaatcatagaggcagccaggtacagtgcctcatgcctgtaatcccagcactttggcagggcaaggcaggaggattgcctgagtccaggagttcaagaccagcctgggcaacatagtgagaccttgtctctacaaaaaataatttttaaaaattagcatgcacctttagtcccagctactcaggaggctgaggtggggggattgcttgagcccgggaggtcaaggctccagtgaactgagattacaccactgcactccagcttggatgacagagcgagactctgtctcaaaaacaaaacaaaacgaaacaaaacaagaaaacaggccaaacatggtggctcacacctgtaatcccagcactttgggaggctgagatgggcagatcacctgaggtcaggagtttgagaccagcctggccaacatggtgaaaccctgtctctactaaaaatacaaagattagccgggcatggtgatgcacgcctgtaatcccagctacttgggaggctgaggtaggagaattgcttgaacctgggaggcagaggttgcagtgagccaagattgtgccactgcactccagcctgggtgacagagtgagactctgtctcaaaaaaaaaaaaaaaggaaaagaaaagaaattatagaggctcaaaaggcagtggggcaaaaactggcaaccaaagtttctacatccagcaaagcaattctttaaaaattaagggccggagccaggcatgatggctcaggcctataaacccagcactttgggagatttaggtgggcagattgctggagctcaggagttggagaccagcctgggcaacatgggtgaagccccgtcttactttattaaaaaaaaaaaaaattaagggttagatgtggttgctgacacctataatcccagcactttggaaggccaaggcaggaggtttgtttaagcccaggagttcaagactagtctagttaacatagatgagaccctatctctacaaacaagttaaaaattagctaggcgtggtggcatgcatctgtagtcccagcatcttcgtaggctgaggtgggaagatatttgaaccgaagaggttggggctgcagtgaaccatgataaggagaactaaacagaaatttgcacaccaatagtcatagcagcattatttacgatagccgaaaggtggaaacaaccagagtgtctatcaacagacaaatggaccaacaaaatgtgatatattaatatactggaatattattcagctgtaaaaatgaatgaaattctgagacatgctacaacatggatgaaccttgagaacattatgctaagggaagtaagccagtcacaaaaagacaaatactgtccactttatggggtacctaaagtagttaaattcatagagatagaaagtagaatggggttgccagggctcagaggagagagaactaggaagctaatctttaatgggcatggggtttttaattagagaagatgaaaaatttctagagatggaaggcagtgatggtagcacaacaatgtgaacgtactcagtgccccagaactgtacatttaaaactggttgaaatgaagcatacaaatatgcacttagaagacacaagacctggctgggcctggtggctcatacctgtaatcccagcactttgggaggccgaagccagcagatcatgaagtcaggagttcaagatcagcctggccaacatggtgaaaccctgtctctactaaaaaaaaaatacacacacacgaagacacaagaccgctcagcgtgatgacctatgcctgtaatcccagcactttaggaggtggaggcaggtggatcacttgaaggagctcaagaccagcctgaccaacatggtgaaaccccatctctactaaaaatacaaaattagccgggcgtggtggctcacgcctgtaatcccagcactttgggaggcagaggcgggtggatcacctgagatcgggagttcgagaccagcctgaccaacatagagtaacccggtctctactaaaaatacaaaattaggtgggcatggtggtgcatgcctgtaatcccagctactcaggaggctgaggcaggagaatcacttgaacccgggaggcggaagttgtggtatgccaagatcaaaccattgcactccagcctgggcaataagaacgaaactcggtctcaaaaaaaaaaaaaaaaaaaggccagtcaccgtgactcacacctgtaatcccagcactttgagaggccaaggcagggaaatcacttgaggccagttcagtaccagcctagccaacatggtgaaaccccatctctactaaaaatacaaaaaattagccaagtatggtggcatgcacctgtagtcccagctacttaggaggctaaggcacaagaattggttgaacctgggaggcagaggttgcagtgaaccaagatcatgtcactgtactccagcctgaatgacagagactctgctcaaaaaaaaaaagaaagaaagaaagaaagaagaaatagataaaaacaacaaatgtttaaaggttaaaatggtaaattttctgttatgtgtattttaccacaacaagaaaagataaaatgttaaataaaaagagcaactaaagagaatttaactctagcacatccatttttcaggctgaaatgaaagaacaggtgacactaactcaaatccacatgaagtggagagcattggaaaaggtaactaaataaaggcaaatataaaagacagtatagatgtatgttttgtttgtgactctttttctctcctgtcttacttcagacaactgcataaagcactaatataaaacatgaaatatatattgagggtcatatattctataaacatgcatttgcttggcaataatagtacaaagaaggttgagggaatggtcctttgtaggagcaagttttgtacactattgaaattaaattggcatggttccaaattgtattgttttaagatgttaatggcaaccactaagaaaataactaaaaatatatagtaaaagaatgacaatgcaataactatagtatactagaaaatatttacttaacagaaaagaaggcagtaatggagtattaaataagacttaaaatgtattaaaaatagcaaaatggcagatatatatcctatgttatctgtaattaaatgtaaatggactaaacacttcaatcaataggcagagattttcagaatggattttaaaaataaaactacatgctatttacaagagacaaaattcagattcaaagacacagatagagttaaaagaacagagatggtccaagtgtggtggttcatgcctgtaatcccagcactttgggaggccaagacaggcagattgcttgagcccaggagttcaagaccagcctgggcaacatgatgaaaccctgtctctacaaaaaatacaaaaattggccaggcaaaatggtgtgtgcctgtagtcttagtagtcttagttacgcaagaggctgaggcaaaaggattgattgagcccaggaggtggaggctgcagtgagctctgatcacatcactgcactccagcctaggtaacagagggagattccatctctaaaaaaaataataataattgaagacaatagaatcaaacctttcagctttgccaagtctcatgatttttcatttgtctcagatcagttttttaaaacaaaacatgcaaaatttattgcaatctatcccactcactcccaacagccagagataattactatcctaaatttggtgttgaccattcccttatgtttttatacttttactatatatataatacatgtattttactatatataatatatattttactatatataatatatattatactatatattatatttgtaattatactttataatatattatatattatactataaaatatattacatttgtgggccgggtgcggtggctcacgcctgtaatcccagcactttgggaggccaaggcaggtggatcacgaagtcaggagtttaagaccagcctagccaacatggtgaaaccctgtctctactaaaaatacaaaaatgagctgggcgtggtggcaggtgcctgcagtcccagctacttgagagggtgaggcagagaattgcttggacccgggaggcagaggttgcagtgagccgggatcgcgccactgtactccagcctggaggacagagtgagactccatctcaagaaaaaaaaatatatataaaatatttgtaattatactatataaaatattatatagtatatatattttaagtatagtaaaagttttttatactttacacatagtaaaagtataaaaacataagggggccgggcacagtggctcatgcctgtaatcctagcactttaagaggccaaggcgggtggattacctgaggttaagagttcaagaccagcctggccaaaatggtgaaaccctgtctctactaaaactacaaaaattagctgcgcgtggtggcatgtgcctgtagtcccagctactcgggaggctgaggcaggagaatagcttgaacccaggaggcagaggttgcagtgagctgagatggtaccactgcactccagcttgggcagcagagtaagactccatctcaaaaataaataaataaataaaaataaggcaatgattatatatatagtattgttttacatcttaaaactttatgtagatgatatcataccataaacatccttctgcaacatgattttcttgggtaacattatgattttgagattcagccatgtttgttcactctgagcatctggaatgcatcaataaacaaagctgacaaagatccctgccttcacaaaaggagatcaggctagaaaaaaaggaaaacaggaccgggtaggtgagctagtgaccatcaagagaaggagcctttgcaactataaacaaagtgtgtgtcaggtaatgtcagaaaaataattgggtaggtgagggtggattgggggatgttggccacagagagggttgtaggccattgaggccattgtgaggattttgctttcactgaaatgaaatgaagagttttgagcagagtagagatatgacctgacttacatttttgaaatgctgatacatatagctctggttcattaattttaacttttgcatagtggtctattgtaggatcatacattaaagtattgattcattctcctattagtggtcaattaagttattttcatattcattatatataatgctgcagtggacacttttgtatttgtcctttagggcacttgcgggagaattttcctaagaaggaaatctttggatcggagggcatttgcctttttaatattatttgtaataactattattactaattattagtaatattatcagtaataactaataattgccaaactgctctagaaagaggatgtcccactttacactggcaccagcatttatagaagtttcatttgccgcccagtctcaccagccctttttttttttttgagacaaggtctcgctctgtcgcccaggctggagtgcactggcgtgatctcggctcactgcaacctcctacctcccaggttcaagcaattctcctgtctcagcctcccaagtagctggaattacaggctcacaccatcatgcccggctaatttttgtatttttagtagagacggggtttcgccacgttggccaggctggtatcgaactcatgacctcaagtgattcgaatcccagcactttgggaggccaaggtgggcagatcacttgaggtcaggagtttgagaccagcctaaccaacatggtgaaaccccatctctactaaaaatacaaaaaaaaaattagccgggtgttgtggcaggcacctgtaatcccaactgctcggtaggctgaggcaggagaatcgcttgagccaggaggtggaggttgcagtgagtggagatcgcgccgctgcacttcagcttaggcgataaagagaggctccttctcaataagaaacaaacaaaaataaaaacaaagtgctgggattacaggcttgagccaccaccacatgtctgcccctcacccgcccttgaaatagctctttgtggttttaatttgcatttccccatccctggtgaagttcagcacctttttcatgtttatttgtggtttggtcttttcttctctgattgcctcttgatgttctttatccttattctatggagctatttctccaccaccccccttttttttgagacagagtccccttctgtctcgcaggctagagtgcagtagtgtgatctctgatcactgcaacctccgcctcccaggttcaagcagttctaatgtctcatcctccttagttgggattacaagcctgcgctaccacgcctgactaagcctggataattttttgtatttttagtagagacagggttttgccatgttgtccaagctggtcttgaactatttctcacttaaaaaaaatttttttttttttgttttgagatgggcgctctgttgcccaggctggagtgcagtggcacgatctcagctcactgcaacctccccttccctggttcaagaaacgatcctcccacctcaacctcttgagtagctgggattacaagtgtgcaccatcacgcctgactaatttttgtatttttagtagagacggatttcaccaagttggccaggctagtcttgaactcctggcctcaagtgatcctcagcctcccaaagtgctgggattacaggcatgagccacctcacccagcctaaaagttgatttttagatattctgtatatattctagatactgatattttgttaattatacacaatccattgctgattatatgtaacacaaacatcttctccccttctctgtcttgtcttttttcttttctttttttttttttttttttttttttttttttgagatggagtctcgccctgtcgcccaggcttgagtgcaatggcaccatctcggcttactgcaacctgtgcctcccgggttcaagcaattctgtctcagcctcctgagtagctgggattacagacatgcatcaccacgcctggctaatttttgtatttttagcagagatagggtttcaccatgttggccaggctggtcttgaactcctggcctcaagtgatccacccgtcttggcctcccaaagcgctgggattgcaagcttgagccactgcgcccggccgtcttcattttttaaaactgacatcttttgttgcacagaaccctttcatttttttatgcagttgaatatttgaatctttttctttcaaggcttgtgatttttgtgttttgtttaagaaatgttcctctacaccaaggtcataacattttctcatattcattcctcctttaaatttgttaatacgatcaatctggattatgtcgagagggaaggggaagtctgatctgtccctttagaggtgactttgcatatctcaccaggattctttggtgttgacttcatggcttaactctgtagatagtcctgttctccttatttacaggttgcaaggaaagctttattgaaatgtccaaatcttaggcagatttttatttaatggacctgtggcagggcccaagaacctgcatttttatttgcaacccaggtgattttgatgaaagaggtttccttttaaattattgatagtgctgaagccatcttctcaggtgtccagcaacttggaaatgaacctactctttgttggctggtgattgagccttgctctgccttggttcctctttggtaaaagtggatggccaaagtccctcctgggagatggggagtcccatgatgagtgggatgactctcacatataaaagtttagcccgccttgcatttgtcagacactcagtaaacagtggaccttccttaactcctgaggtcccaagctcagggttgagcctgccctgcctcccttctagaccatctcccaccatgcacccaacttgggcaagtcccataacccctcacagcctcaatgccatcatctgtaaattcattaatttgctggctgggcacagtggctcacatctataaacctagcactttgggagtctgaggctggaggattgcttgagcccaagggtttgagaccagcctgggcaacatagtgagacgctatctctacaaaaaacttttaaaaattagcaaagtgtggtgatacacatctgtagtcccagctaccgcagagggtgaagtgggaggatcacttgaacccaggaggtcaagactgcaataagccatgactgcgccactgcagtccagcctgggtgacagagtgagaccctttctcaaaacaaacaaacgaacaaacaatagtctttgcgttacaaggttgttgtaaggattggagtggcatataaacacccaggacagtgccagaatgcagtatcactacaagagactgtggaagctgagcagttgtgtttttaatcctggagaatctgaaagattcctggagcatctcccatgttgcttcccaatgcctagaacaatatcggacattctgtaaagatttggtaaattcatgttctttccattgcaggacacaattctcacattccatcagtgtctccaaagaacctacaaaactggaaaaatatattcgatcattttatttaacaggtgtttatatagggcttgcagtacatcaggccctgctgtaagtgctttataataattaactcatttaatcttcataacaactctatgagggagatactattattattatcattttgcagatgaggaactgagatgaggagcagccctggactgagtgaattgaaccctctgggtgtgttacattcaggatggtggaacaagacccctgggaagaaggtaattcaaaccctggttcttctggatgctttctgtttcagatgagggaagcctttggaattgaaaatcaattcaaactgagcaatattagttgtaatttttgtattttaaaaccatcctaccacggcatccccatttggatggttactatcaaaaaataaaaacagggctgggcgtggtggctcatgactgtaatcccagcactttgggaggccgaggcaggcggatcacaaggccagtagttcgagaccagcctggccaatatggtgaaaccccatctctattaaaaacacaaaaattagccgggtgtggtggcgggtgcctatagtcccagctacacaggaggctgaggcaggaaaatcacttgaacctgggaggcggaggttgcagtgaaccgagattacgccactgcactccagcctgggtgacagagagagagagactctgtctcaaaaaataaataaataaataaataaataaaaataaaaataggccgggcgcagtggctcatgcctgtaatcccagcactttgggaggccgaggcaggtggatcatgaggtcaggaattcaagaccagcctggccaagatggtgaaaccccatctctactaaaaatacaaaaattagccaggcgtggtggcaggcgcctgtaatcccagctactcgggaggctgaggcaggagaatcgcttgaacccggggggcggaggttgcagtgagccgagatcgtgacactgcacttcagcttgggcaacagagtgagactctatctcaaataataataataataataataataaaaacaaaacagaaaataacaagtgttggcaaggatgtgaagaaactgaaaacttgtgcactgctggtgggaatataaaatggtatagcctcttggaagacagtatggcagttcctcaaaaaattaaaaatagaattagcacatgacccagcaattctacttctgtgtatatacccaaaaacacttgaaagcagggattggaggatatacttgtattcctatgtgtacagcagcattattcataatagtcaaaagtggaaacaacccaagtgtccattggtggatgaatagataaagaaaacatggtatattcacacaatggaaatgactcatccttaaaaggaaggaaattctgacacacggtataacatagatgaatgttgaggacgctgtgccaagtgaaataagccagtcacaaagataaacactgtacgattccacttacgtgaggcacctagagtagtcaaattcatagagacagaaagtagaatactggctgccagaaacagtgggcagggctggagggggagttcttgtttaattggtatagagtttctgtcttgcaagatgaaaagagttctatggatggatggcagtaacagtagcacgatgtgaatgtacttaatgccgcagaactgtactcttaaaaatggttaagggccaggcatggtggcataaacctgtcatcctggcactttgggaggccaaattgggagtatgccagttagaatggctattattatttttatttttttttgaggcacagtcttgttctgtcacccagtctggagatcagtggtgcaatcttggctcactgcaacccccgcctcccatgttcaagcaattctcctgcctcagtccctcgagtatgggactacaggcgtgcgccaccatgcccagctaatttttgtaatttcagtagagacagggtttcaccatgttggctaggctggtcttgagttcctgacctcagctgatctgcccgccttggcctcccaaagtgctgggattacaggcgtgacccaccatacctggccagaatggctattattaaaaagacaaaaaacaacagatgttggtgaggatgcagggtaaagggaatacttccacactgttggtaagaatgtaaattagcatagacactatgaaaaacagtatggctgggcatgatggctcacacctgtaatcccagcactttgggaggatgagatgggtggattgcttgaggccaggagttcgaaaccagcctggccaacaaggtgaaaccccatctctactaaaaatacaaaaaattagtcgggctgctgggtgtgatggctcatgcctgtaatcccagcactttgggaggccgaggtgggtggatcacctgaggtcaagagtttgagaccagcctgaccaacatggagaaaccccgtctctactaaaaatacaaaatgagccgggtatggtggcgtatgcctgtaatcccagctattcgggaggctgaggcaggagaatcgcttgaacccgggaggcagaggttgcggtgagccgagatcacgccattgcactccggcctgggcaacaagagcgaaactccatctaaaaaaaaaaaaattagctgggcatggtggtgtgtgcctgtaatcccagctactcaggaggctgaggcaggagaattgcttgaacccgggagggagaggttgcagtgagccgagatcacaccactgtactccagcctgagcaacaagagcaaaactccatctcaaaaaaaaaagaaaaaaagaaaaatagtatggagatttcctgaaaaactaaaaatattaatagaactaccatacaatccagtaattctactacttgttatttatccaaaggaaaagaaatcagtacatcaaagggatatctgcacccccatgtttgttgtagcaatattcacaatagcaaagatatggaatcaacctaagtgtccatcaatggactaatagataaagaaaatatgacatatatacacaacggaatagtattcagccataaaaaggaatgaatgaaatcacatcatttgcagcaacatgggtggaactggaggtcattatgttaagtgaaataggtcaggcacagaaagacaaatatcacatgttttcactcatatgtgggagctaaaaaaaagttaacatcatggaggcagagagtagaataatagatactagaggctgcaaaggatgtgtgggtgcgaggaagggatgaagaaagattggtcaatgggtacaaacatacagttggttagaaggtgtaagttctagtatttgacagtaaagtgagatgactagttagcaacaatgtattatatatttcaaaatggctagaagcaaggacttgaaatgctcccaacatatagaaacgataaatactcaagttgatggacacccctaataccctgacttgatttttacccattccatgcatgtgacaaaatatcacatgtaccccataactgtgtaaaatatgaggtatcaataaatattattattattattttagagacaaggtcttgctctgtcaccctggctggagtgcagtggcatgatcttggctcactgaagcctcaaacttctgaactcaagtgatcctcccacctcagcttcctgagtagctgggattaccagcatgcaccaccatgcctgactaattaaaaaaaaatttttttttgtaaagaagcggtctcaccatgttacccaggctggtttcaaatgatcctggtctcaagtgatcctcctccctttgcctcccaaagtgctgagattacagatgtgagccaccatgtcaaacaattttttttttttttgagacagggtggagtgcagttgtgtgatcatagctcattgcagcctccaactcctgggctcaagcaatcctcctgcctccacctcctaagtagctgaaactacaggtgcatgccatcacacttgactaatttttacattgtttgtaacaacgaggtcttgccatgttgcgcaggcttgtctcaaattcctggcctcaagtgatccaactgccttggccttcttaagtgttgggattacaggtgtgagccaccatgtccagccccttttgctgctttttttttttttcttgagacagagtttcgctcttgttgcgcaggcaggagtgcaatggcgcaatcttggctcaccccaacctctgcctcccaggttcaagcgattctcctgcctcagccacccaagtagctgggatcacaggcatgcaccattatgccgtctaattttgtatttttagtagagatgaagtttctccatgttggtcaggctggtctcgaactcccgacctcaggtgatccgcccgcctcagcatcctaaagtgctgagattacaggtgtgagccactggacctggcctcctttttctgatttttaagtaatgtttctttttttttttttttttaaacggagtctcactctgtcactcaggctggagtgcagtggcgtgatctcggctcactgcaacctccgcctccgggttcaagcaattctcctgcctcagcctctccagtagctgggtttacaggcatgcaccaccatgcccagctaatttttgtagttttagtagagacagggtttcaccatcttggccaggctggtcttgaactcctcacctcaggtgatctgcccacctcagcctcccaaggtgctgggattacaggtgtgagccaccacacccagccagattttgaaataatgtttccgataaaactttcaaacatcgcaaatgttttgaacaaagaacgtgagtgcttcccataacctcatattctctttttttttttttttttttttgagacctggctggtctcaaactcctagcctcaagcaatccttctgcctcagttggttctttcagtgaaagaaatgtgctgtgcattttttttttttttttgagatggagtctcactctgtcacccaggctagagagcaatggcgtggtcttggctcactgcaacctccgcctcccaagttcaagcaattctcccacctcagcctctcaagtagctgggactacaggtgcatgccaccacacccggctaatttttgtatttttactagagacaaggtttcactatgttggccaggctggtgtcaaactcctgacctcgtgatccgcccacgtcggcctccccaagtgctggggttaaaggtataagccaccatgcccagcttgtgcatatattaacccataaagtaattaatattttcacaatattaataaccatgtctaatctattttgacagcacagagccagccttttccttcatttctgggagaagtccttccccaggaaagccaagcttccactttccaccttcaaatcaaatgcaccagtgctcaaatggggttccaggcaaagatggtgggcttgaggctcactggaagatggagaaatattattagaagcaattttgccagcctgcacaacatagggagactacgtttctactaaataagtaaataaatatataggctgggtgtggtggttcatgccgtaatcctagcacttttagaggcagatgcaggagaatcgcttgaggccaggagttcaagatgagcctgggcaacagggccaggtcctgtctcaatttaaaaatatataaatatatatatatttttttttaaaaaagaaaacattgaaaaaaagaataaaaattagctgggtgtagtggcacatgcctgtggtctcacatacttgggaggctgaggtgggaggatcacttgaggcagggatgttgaggctgctgtgagctatgatcatgccattgcactctagcactccagcctgagtgacaaagcgaaaccctgcctcaaaaaaaaaaaattttttttttttgtaaaaatgtaatacctgggccgggcgcagtggttcacacctgtaatcccagcattttgggaggccaaggtgggcagatcacttaaggtcaggagtttgagaccagcctggccaacatagtgaaatcccgtctctactaaaaatacaaaaattagccaggcgtggtggcgggcgcctgtaatcccaggtacttgggaggctgaggtaggagaatcacttgaacccgggtggcagaagttgcaataagcagaggttgcagtgagccgagatcacgccactgtgctctccagcccggctgacagagcaagactctgcctcaaaaaaataaataaataatggccaggcctcccagggaggcagaggtgggtggatcacctgaggtctggagttcgagaccagcctgaccaacatggagaaaccccttctctactaaaaatacaaaatttagccaggtgtggtggcacatgcctgtaatcccagtttactcaggaggctgagacaggagaatcacgtgaaccagggaggtggaagttgcggtgagccgagattgcaccattgcactctggcctgggcaacaaaagcgaaactccgtctcaaaaaatgaatgaataaataaataaataaataaataaataatgtggcctggcgcggtggctcacgcctgtaatcccagcactttgggaagctgaggcgggtggatcacgaggtcaggagttcgagaccagcctgaccaacatggtgaaaccccgtctctactaaaaatacaaaaattagccaggcgtggtggcacgcctgtaatcccagctactcaggaggctgaggcaggagaatcgcttgaacccagaaggaggaggttgcagtgagtcaagattgcaccactgctctccatcctgggcgacagggcgagactccgtctcaaaaaaaaaaaaaaaagtaatacctgaattcctatacttctcagtatgtacagtgattaatattaacctaaactattccctgaataagacctcaattcagaaaattcagggtgtttggatgctgtattcattcattcagtcaatcaattcagaaatcaatgtttccccaatgcttcttaagccatgccagatttgttgctagacatagaatcccacagaaaacaaaaagagacttggtttggggggaaaacaacttatttaatttcttattcttagagacagtgtatcactctattgcccaggctggagtgcggtggcgtgatcttggctcactgcaacatatgcctcccaggctcaggagatcttcccacctcagcctcctgagtagctgggactacaggtgtgcaacaccacgcccgcctagttttggtattttttttgtagatacagggtttcaccttcaaaaaatttgctgggcatagtggcgcatgtctgtagtcccagctactcaggaggctgaggtgggaggatcacctgaacctgggaggttgaggctgcaatgagccataattgtaccactgcattccagccttcgcaacagagggagatcctgtctcaaaaaaaaaagtattttatcaaaaatgcagccgggcgctgtggctcacgcctgtaatctcagtactttgggaggccgaggcaggcagatcacatgaggtcaggagttagagaccagcctggctaacatggtgaaaccctgtctctactaaaacgcaaaattagctaggcagggtggcgtgcacatgtaatcccagctactcaggaggctaaagcacgagaattgcttgaacctgggaagcagagtactgtagtgagccaaaattgcaccactgcactccagcctgggcaacagggtgagactccatctccagaaaaaaaacaaaagcatgaccaggtattgtgtggctcatgcttgtaatcctagcactttgggaagatgagacaggtggatcacttgaggctaggagtttgagaccaccctggccaacatggcaaaaccccatctctactaaaaatacaaaaattagccaggcattgtggtgtatgcctgtaatcccagctacttgggaggctgaggcacgagaatcacttgaatccaggagtcagagagtgcagtgagcagagaccacgccactacactccagcctgggtgctgggtgatagaggaagactctgtctcaaaaaaaaaaaaaaaaaaaaaagcgtaacctaaatcaaatcataaggaaacatcagacaaacccaaactaaagggaattctacaaaatgacttgcctgaaacctttaaaaacatcaagttcatgaagactaggaaaggctgaggaactcttccagattaagaaggaaattaagcaaacaggacaaataaatgcaacatgtgatcctggactggctcctggtctggaaaagagaaagctataaaggcctttaattggacaattagtgaaatttgaatatgaatttcagcttagataacagcaatttaacaatgttaaattttctgcatttgataattgtacagtgattatttaagaggatgtccttcatgttagcagtgaagatggaaatatttaagggtaaaaatctatgatttgctctcaaatgttcatttaaactataattttaggctgggcacagtggttcacgcctgtaatcccaacactttgggaggctgaggtgggcggaacacctgagatcaggagtttgagaccagcctagccaacatggtgaaaccccatctctactaaaaatacaaaaattagccaggcgtggtggcacgcgcctgtaatcccagctactcaggaggctgaagtaggagaatagcttgaacctgggaggtagaggttgcagtgagccgagatcctgccactgccctccagcctgggacagtgcaagactgtctcaaaaaaaaaaaaaaaaaaaaaccccaaaactacccgaacatggtggcgggtacctgtaaacccagctactcaggaggctgaggcaggagaatcgcttgaacccaggaggtggaggttgcagtgagccgagatcgcgccattgcattccagcctgggcaacaagagtgagattttatttcgaaaaaaaagtgaaaaataaaaaataatttggtaagcaggttgataaaaaaaaaaataatagcgatatatattgtatacagaatgctgaagtaaatgcagcaaaaatatgaattggtgaacataggtgaggcgtgtatgggagttccttaaggtgtttttgcaacttttctgtaaatttgacatgcttttcaaaataaaaatttaaaattaagaaagcctgttaagatatgtaaaggaagggtaggggtgattgctgaaaggggctccatcgaggactaaccctgccaatagaatggtactgtatgccagagcacagccacactgatgtccctccagtgccacactgatgtccctcactcctggaaagggcctctgtagaagatgatactgggccaggtgtggtggctcccgcctataatcccagcactttgggaggctgaggcaggtggatcacctgaggtcgggagttcaagaccagcctgaccaacttggagaaaccttgtttctactaaaaatacaaaattagccaggcgtggtggcgcacgcctgtagtcccagctacttgggaggctgagacagaatcgcttgaacccgggaggtggaggttgcagtgaaccgagattgccattgcactccagcctgggcaacaggagtgaaattccgtctcaaaaaaaaaaaaaaaaaaaaaaaaagatgataccaatggctgggctccaaaacgaaatcagtgtgggggacaagggttcaccttgtactttgtcccaaatttgcccctaaacatcaagcaacatatgagaacatatgagaccgtgtcagcaatgcctggtctgaccctcctctgttagaagctggaagttattctgtaccttcttgctttaccttttcttttcttttttttttttttggtttgtttgtttcttgctgttgaggccaggaatactctaacgtttccacagatgagttaacatttgcataacaatctgggtgaccctgttctttcctgttggaaagggacttttcttgactcctgagaggataagttgagggtcttttgaagctgcccaggccctatgggtggggacgtgcctgtcagcccaccagtggagagctggagcccagtgagtctcaggggttggaggtgtggcgggccaggagagtgtgttgaatatgggggctaggaagtagggttgggcccagccaaggttgggggtaaaattgtccacactcactcatgtccccttgaaacctattatataaggctagggtaatactttgaaaattcactacattttgtcaccagttgaacacgactgtttcgtggcagaacttgatagaatacaagaatgttttctccttgtgtactatgcagatttgcctaggagaccagaagttcttggcactcacttacaaaatggaagtgcagtcacgaagtatctgttgggtgtctgctggagttcaaatggtaaactaggttgtcaaggttcctgccctcaaggaggtagagagcaagaaaggtcaatggattaccacaatagagtctaaggacagaacgagaaattacctaggccctagacaatagtattttgagttaaaatttttttcttggccatgtctggtggctcatgcccgtaattccagcactttgggaggctgaggtgggagtattgcttgagcccaggagttccagaccagcctgggcaacatagcaagacttcatctccacttaaataaataaaaaaataaaataaaaaagaaaaaatatgtatttttttcttgattaaaaaaaccttggaggccgggcatggtggctcatgcctgtaatcccagcactttgggaggccgaggtgggcagatcacctcaggtcaggagttcaagaccagcctggccaacatggtgaaaccccgtctctactaaaaaatacaaaaattagctgggcatgatggcgcatgcctgtaatccctcggaagtctgaggcaggagaattgcttgaaccaggaggcagaggttgcagtgagccgagattgcgcccctgtgctccagcctgggtgaaacagtaagactctgtctcagaaaaaaaaaacaaaaaaccttagcaaaaattgaccaaaaagtcaaaagacaagtgctcaagtgggaaaaaaaaattgcatatgtgctagctgaagggctaagtcaattaaaaattagactcggccaggcgtggtggctcacacctgtaatcccagcactttgggaggccaagggaggcagatcatctgaggtcaggagtttgagaccagcccggccaacatggcgaaaccccatctctactaaaaatacaaaaattagcagggcatggtggcaggtgcctgtaatcccagctactcgggaggctgaggcaggagaatcacttgaacctgggaggcggaggttgcagtgagccaaaatcgtgccattgcacttcagcctgggcgaggatagtgaaagtctatctcaaaaaaaaaaaaaaagaaagaaaaatgcaaattgaaatttcaacaggatactactttcacattggccaagagcaaaatgttgataatgtttgcggaaggctggggaaacaggctctgccctatatctgagggaagtgtgcattgggccagcctccatgcagggcaagttggctacagctgtcaagatctaaaatgcacatcttatgacccaacaactccaatgctaggaacttatcctacagacacagtaaaaacttgcaacatgtcacactgttaagtgaaaaaagcaagctacaaagcagtgtatatcatatgctatccattgaatgtatatgtaaaatcccatggttaagccataattttcttaactttctcctgttgctgggtatgttgttttcgtgtttttgtgattatattgtaatgctgtgatagacatcttttgtgcatgaatttctgtctacacctaaagctgtttacttgggacagtccagattactgggccaaggagatagcaaaatgaatttacaatagcaaccattgcagcaaccatcaccatctgttaagtgggctgttttgttttgttttgtttcttcatcttctcaacagtcctgtgaggtagggaggagcacctccgttttgtagttgaggaaaggggtttaaaggaggtgaagtgacttgttccagggcacacagctggagtggtgagagcagacctggatctgcttggctctgttgatgaaatgggtcaaattccttaaaatatttggatttattctgagccaaatatgagtgaccatggtccgtgacacagccctcaggaggtcctgagaacatgtgcccaaggtgatcggggcgcagtttggtttaatacattttagggaggcatgaaacatcaatcaaatacatttaagaaatatactggtttggtccagaaaggccagacaattcaaagcgaggggtgggggtagatggggtacttccaggctgtaggtaaatttaaacattttctggttgacaattggttgagtttttctgaagtcctgggatcaggccgggtgcagtggctcacacctgtaatcccagcactttgggaggccgaggtgggcagatcacctgaggttgggagttcgagaccaccctggccaatatgatgacaccccatccctactaaaaatacaaaaattagtcgggcgtggtagcagatgcctgtgattccagctactggagaggctgaggcaggagaatggcttagatccgggaggtggagtttgcagtgagcggagatagcaccattgcactccagcccaggcgacagagcgaaactctgtctaaaagaaaaaaaaaaaaaaaaaaaggctgggcacagtggctcacacctgtaatcccagcactttgggaggccgaggcgggcagatcacctcaggtcggagttccagaccagcctgaccaacatggagaaatcccgtctctactaaaaatacaaaattagcctggcatggtggcacacacctgtaatccaagccacttgggagggtgaggcaggagaattgtttgaatctaggaggcggaggttatggtgagccgagatcatgccattgcactccagcctgggcaacaagagcgaaactccgtctcaaaaaaaaaaaaattatttttggtttacagctcccaaacccctgctttagaggcccttcatctattcggggctttctttttttgagagagagagggtctggctctgttgcacaggttggagtgcagtggcgatcatggctcactgcagcctctgtctcctgtgctcaagtgatcctgctacctgggcctcccaaagtgctgggattactggcataagccaccgcacagggcctacttggtgtattttttaagggtcttggtggctgagcatggtggctcacgcctgcaatccctgcactttgggaggctgaggtgggtggaccacctggggtcaagagttcgacagcagcctggccaacatcatgaaaccccgtctctactaaaaatacaaaaaaattgggcgggcacagtggctcacgcctgtaatcccagcactttgggaggccgaggtgggtggatcatgaggtcaggagttcaagaccagcctggccaacatagtgaaaccctgtctctacttaaaatacaaaaattagccaagcatggtggcatgactctgtagtcccagctacttgggaggttgaggcagcagaatcgcatcgcttgaacctgggaggcagaggttgtggtgagccaaaattgcaccactgcactccagcctgggcaacagagcgagagactctgtctcaaaaaaaaaaaaaaagaaagaaaaaagaaaacaccgaaaaaattagctgggcgtagtggcacgcacctgtaatcccagctactcaggaggctgaggcaggagaatcacttgaacccaggaggtggaggttgcagtgagccgagattgtgtgcgccactgcactccacctgggtaacaagagcaaaactcggtctcaaaaaaaaaaaaaaaaaaaaaaaaaaaagcgggggggctcttcataaacaatgtcaaattactctccagaaacctagtatcagtttatgctcctcacactcccactgagattgccaaactctccacactcaggtcagtgtggagaatggcaatattttcattttgccaactgggagggaaaaaaatagcctctcatagttttgatgatcatgtctttggtaactaatgaatctgaccatttttcatatgtttattcgctgtttgtacttttattaactgttcatgttggactacgtatttttaaaatatgcaaaacattctgaaaactgtaacatgtcgattctttttcttttcttttctttttttttgagacagtctcgctctgtcgcccaggctggagtgcagtggtgcgatcttgctcactgcagcctccgcctcccaggttcaagcagttatcgtgtctcagcctcctgagtagctgggactgcaggtgtgcaccaccacacccagctaatttttgtatttttagtagagacggggtttcaccatgttggccaggctggtctcgaactcctgagctccagcaatcctcctgcctcggcctcccaaagtgctgggattacaggcatgggccaccgcgccaggtaaactgttgattcttaataaatcccagtagagacgtgcgcttgcgtgggcaaaagctcctgccgaggccatcagacgcgttgttgaggctccgggtccttggctttaccctggagacccaagtccaggggccttgggtgcactcagatggagaaaggtggcagcaaggagttggatgtgccactgagacaaaaaccaacgctaatactcaccatccgtgcattgccttctgtaagcgtaacaaatgcctggggccacggtcaccggaaagcccctctccttgtccgcgcctggggtggcttcggggctcgccgctgagacgcggggccaggagcgagtctggcaacttccagagccctccgcccgcctcccctgcctcctgcttaggtcgctgctccggcggggtgaggccgggcgggagcgggcaggctgggcatggcccgcgaggcagggtagccggcttggagcgcggggtccgggaggcaggcgcggggaaggaggccgagcgcgcctgccgggagggcgagcaggaggcggcgggcaaagcctacttcgcttagttttgtgcgcctgacagcagcccttcagcaaggtgaattctttgaggaagggtctcattcacaagctgccaagacatccgcgacctattcttgaattcacacaaaaattaaaggaaaaacaacagcccaactaatttagcaacttgcaagaggcagctggtgctcctttccgcgcccctggggcccagtcttcccctccccaccgcctcccaccccgcccccacccccgcctcgcctctgagaggtctccccagagttattttgtatcctgcagctccaggcctcattgtgacagctgagtgacttagctggcaccgtgggatgcggaatgacaaaggcgcagagcatcggaggcccggtggcagcaggggatggcaagggatggcggaggcttgcagctctgaggaccccccatccagcagccgcctgaggtgcccagtcgcccattccacctccctctaaaataatgcttctatgaattaagtgagaggcttttgcagtccaaaaattggtacttccagtgtcctcgcaggctggagatggtggggtctcaggcttctgcatgtcctggccctgacagttctttttctgtcgctgccagtagcaccttctctctatctcatccattaagtgccaggtctcctgccttctgtccccgaggccacttcgctctccctggcttccccatctttgtgcctccttggtggtgccagcttcctctccagcctgggagaggtcatgggttccaaaggcctgtcctggcagtgccggcctggactcctgaaccgcccccaagggccatccttacagaacagtgacttcaggcctggactctgaattcagacctcactgaggggcaagtggagtgcaatgatcagctgctcagttgggaattctgacctccctgaaactgcttaacacctcagagcacagttttcttgtctgtaaaatggggcataatagcaatatttaaagagaatggttatgaggattacatgagccaattcagggaactcacttaggttgtaagtgctccaaaagtgttagctattattaataatattgttctaccaaacactaaagacatgttcagcaaatatgctccctcagtccacttcagcatcttgagttcccacactatcttcctcagaggttttgagtggagccacagaattacacaacactatccccaatatcagtccccaactcctttaattggcaggaataaagtgttctttccctagccaccctgtaaatcagctcataggtcattaactgttactaagagctccagactaggctgaggaagctgcaaagaggccactgaacagatactgggcagaatttctttctcttcagatacagctgtactcccaagcaacatccttgtttccaaaaaattctacttacacttatgagaaagctaattatttggaagccaataagccaatttctgtcttagtccattttgtgttgctataagaaaatatccaggactgggtaatttatacagaacagaaatttatttctcacagttctggaggctgggaagtccaagatcaaggtgctggcatctggtgaggactgctctctgcttccaagatgaagccttggtcgggtgaggtggctcatgcctgtaatcccagcactttggcaggccgagggcagcggatcacctgaggtgaggagttcgagatcagcctgaccaacatggtgaaaccctgtctctactaaaaatacaacaattagctgggcatggtggtgcatgcccgtaatcccagctactcgggaagctgaggcaggagtatcacttcaatctgggaggtggaggttgctatgagccaagatcacaccactgcactccagcctgggcaacagagcaagactccatctcaaaaataaaataaaataaaataaaataaaataaaataaaataaaataaaataaaataaagatgaaggcttgaatgctgcatcttctgcaggggaggagcactacgtcctcacatggcagacggcagaagggcagaaaggtatggctttaagaaaaatatttgggtcgggtgcagtggctcacccctgtaatcccagcattttgggagccgaggcaaacggatcacctgaggtcaggagttcaagaccagcctggccaaactggcgaaaccctgtctctactaaaaatacaaaaaattagccaggtgtggtggagggtgcctgtaatcccaactacttgggaggctgaggcagaacaatcactggaacctgggaggtggagttgcagtgagtcgagatcacaccactgcactccagtctgggtgacagagtgagactgcatctcaaaaaaatgaaaaaggaagatatttgggtcgtattgcatttagggaacacagtggttctccctgccatccatggctttgctttctgcagtttcagttacctgaagtcaatgtggtctaaaaatattaaatgaaaaattccagaaataaacaagtagcatgatgaaatctcacaccatccctccatcctttcttcatcacaagaagggtacaataagatattttgagagggagactacattcccataacttttagtacagtatattattatattttttctgtttttaaattattaataattattttgagatagagtctcactctgtcacccaggctggagtgcagtggcatgatcatgctcaccacagcctcaaccttccaggctcaagctgtcctcccaactcagcctgctaagtagctgggattacaggcatgtgaacagctaatttttaaattttttgtagagatgctacaataaattttgttgccctggctctattttattattaattgttgttgctaatcttttactgtgcctaatttatagattaaactttatcatagatatgtatatatagaaaaaaaaccatagtatatataggattcagtactatctgtggtttcaggcatccactgggaatcttggaacatatcccctgaacactactgtttgttaatttaggttaagcaataccacctgctatagcagaaaaacttcagcatctcttcggcttaacacaataaggtgtatttctcctgttacatatcagaacaagtgggaggagtctgctccatgcagttacttaggggtccacgctaatggcagctctgctaacttgtagctcatcatctggaacacatggcttctgagatactaccgaaggggaagagaggaatggagaatgactcactctggttcttaactctttgaaccagaagtaacacatatcatttcagcttctcatccattggctgaaactagccacatggttctaacctaatggaggggaaggctatgaaatgcaggggtgcacagggactatttggtgaacactaatttttctgctacagagaaagatattacaaattacaaataagctgaacttagagttatttcatgtcatcagttgcaattcaggaaacgaaatctaggaattattacagactgtttaccacaggttatgactccatgtgtggcattggaattggtagaaaacagatctcagtctcggtaacagatatgccaagtcacattggccatggaagtgaggcacatggagcagatgaataggctgcaaacaccagaaggggcagctcagataagaggtcctcaaaatatgatacttgattttggaaagagaaaaggtacaatgggaacagttccaagactatgtatgtacatatataccacagaaaaaaatagcaaatgtagtacatgtaataaaaatagaacactccattggtcaaatgctaagatgctacgtgtttaaagtcactcttcaacaaacacacacagagtagaaaaagtggttttagactgggtaacaggaagtactactttacggtagttaggaaatatattcatgcaggcttcatgtatttaatgaatgtctatgatgtgtttgacatttacaagaaatctgtaagcatatgaagtttacagtctaatttctgaatttagacagatagatcttagataaacagataacagatccttaaccttttattttacttaacattatttattactactatgtgcaagacactttggagaatataaagatgaaccaaccccaatcccaaccctgaagcaatttataggcaaggttgtaggctgagtgcggtggctcactcctgtaatcccagcactttgggaggccaaggtgggcggatcacttgaggtcaggagttcaagaccagcctggccagcatggtgaaaccccatctctactaaaaacacaaaaattagccgggtatggtggtgcacgcctgtagtcccagctactcaggaggctgaggcagaagaattgcttgagtctgggaggctgatctgagattgcaccactgcattccagcctgaatgacagagcaagactctgtctcaaaaaaaaaaaaaaaaaaaaaaaaaaggctcaggtgtggtggcttacgtctgtaatcccagcactttgggaggctgaggtgggtggatcacgaggtcaggagttcaagaccagcctggccaagatgttgaaaccctgtctctactgaaagtacaaaaattagctgggtatggcggtaggtgcctgtaatcccagctatttgggaggctgaggcaaagaattgcttgaacccgggaggtggaggttgcagtgagccgagatcgtgccactgcgctccagcctgggcaacagagcaagactcagtctcaaaaaaaaaaacaaggctgtatgaagctgagctatgccctcttacaagcagtctcgttactgataccagtaggtatcagagaggtatcaagctggtgaaatggttcaccagactgatccccttggccttccttgggatgcaacttgaaagatgaactttaacctgaagttcaataatgaacctgccactttgggaggccaaagcgggaagttcgcttgagctcaagagttcaagaccagcctggataatatagtgagaccttatctcattttttttttaagccggagtcttgctctgtcacccagtctggcatgcaatggcctgatcttggctcactgcaaactccgcctcccaggttcacaccattctcctgcctcagcctcccaagtagctgggactataggcacccgccaccacgcccagctaatttttttgtatttttagtagagacagggttcaccaggttagccaggatggtctcaatctcctgacctcgtgatccgcccgccttggcctcccaaagtgctgggattacaggagtgagccaccgcgcccagccaactttatctcatttttaaaaaatacatttaaagaggaaataatgaacttgccaacttgaatgacctgatgctgtctgcattggttaccttatagctggaaaggcaaattcagggcccctgtctgcaattatggtgaaaaattggccaggcgcagtggctcatgcttgtaatcccagcactttgggaggctgaggcgggcggatcacctgaggtcaggagttcaagatcagcctggccaacatggcaaaaccccgtctctactaaaaatacaaaaaagttagccgaatgtggtggctcacgcctgtaatcccagcactttaggaggctgaggcggccgaggaaggtggatcactttgagctcaggagtttgagaccaacttcggcaacatggcgaaacctcatctctactaagaatacaaaaattagccaggcatggtgacatgggcctgcagtcccagctacttgggaggctgaggcaggagaatcacttgaaccgaggaggcagagattccagtgagctgagatcgtaccactgcactccagcttgggcgacagagtgagactctgtctcgaaaaaaaaaaaaaaaagaataagaaaaaaaacctctttccagttagatgcgcacattaggttgcaaaaactggagaaaattgttagtagttaaattaaacttgacttatacttccttacccctgtaaatttataaagtagtccagtgattcttaaatgtactctggtcagttaaccagatacgaagatagtttcattgtctatattgaaatagaaaataaaaaaagaagaaaaaagtgagaaaatgaacatattgatataaagttgcccactcttttttcatgggaagggctatcttttattcagggagtatgttcttcttactattttgggggataaaatgtcctttattctgtgaaatgatgctgatagtagatagccattagttctttttaaaaatgtccttattatcaaaattaaaagttggtggccgggcacggtggctcgcgcctgtaatcccagcactttgggaggccaaggcgggcagatcacttgaggtcaggagttcaagatcagcctgactgacatggagaaaccctgtttctactaaaaatacaaaattagccaggcatggtggtgcatgcctgtaatcccagctacttgggaggctgaggcatgagaattgcttgaaaccaggaggcagaggttgtggtgagccgagattgtgccattgtactccagcctgggcaacaagagcgaaactccatctcaaaaaaaaaaaaaaagttggcaactctcagtttcctcaaattctttttgaagtgttactctcctacaaaatccaaaagactgtgaatcgcaaagttaaacactggggtggttcaaatttttgttttttagagacagggttctactctgtcacccaggctggagtgcagtgatggagtcatagctcactgtagcctccaactcctgggctcaagtgatcctcccacgtcagcctccccagtagctgagactacaggtgtgtgtcaccatgtctggctaatatttaaattttttatagagataggggtctggctatcttgcctaggctggtgtcaaactcctggcctccagccatcctcccatctcagcctcccaaagcattgggaatacaggtgtgagtcaccataccctgtccaaattttctttggtatagcctggtgctaaaaactgtctttattaagactatttggacatcactaattgatatgattagtgaaaggccacctcacctttgagtctcaaaacaaaaaccaaaagatccccgacaactttgttcttcaacaatctttagctaattctacaatctcttatcactctcctgtcttcctcagaatctctcatttgaggctgaggcatgtttctggtttatagaaatcaatggtcgggctagtcttgacctcctgggctcaagcggcctcccaaagtgctgggattacgggccctgtaattccagtacttttggaggctgtttgaacccaggagttcaagaccagcctgggcaacatggtgaaaccctgtctctattaaaaatacaaaaaattagccgggtgtgatggcatactcctgtagtcccagctaaccggaggctgaggtgggaggatcgcctgagcctgggaagttgaggctgcagtgaggcatgattgtgccactgcactccagcatgggcaacaggaacaagaccctgtcttaagataaataaataaataagaaataaatcaatggttgttcaccctgactgcacagggtgatttggaaaaatgctgatgaagggcccctctccccaaatattctaatttaattggccttacgtgggacttaggctctaggctggttcaagagctcctcaggtgattgctacgtgtggccagggaggcaaaccacaggtatgaatggtgtgtcttcattaagtagcttttatggcactagggcagttacacagatgaacaaactggtccatgcagtagaaaagctaattaggaaaacaggcaaaatatgacaagagagtagggtaaatgcttttatttattccataattcaacaaatattagctaagcacttaacaagcgccagtgctggagtgaagccaggctctcagtcctgtgggctacctgcaaaaaccaggaaaacttcacagaggaggcagcagccaagcaggaattgggaggagtgcttagccaaggtctttatcagataaggcagggagtgagggcatcgcagtgaggacagggtgtgctgggcacagacaagtggcaggctcgggaagctggagatgagatactagtgaggtgcagatatgcatacctttagaggactaaggggtttaggcttggtccagaacgcatttaaaagacgttaaaggttttaaagcaggaatgcataaattagatgtgggtacagaatactggtatttgagataaccccagctgttcataaaggcagctgtagctagaatttcctaaccagtttaatgctttgactgatcatcccccatcccctctgcccttgactgaagtaaccagacattgtgaccttgtggggtcagtttctagtcaatgaagggagaggattccatgtggcagttggaagggaggtgtagatcaatgttttttaagtgactaattgaatgtaaatagaattcaccatgggctgggccctggacaaatacgtttagcgtccttgcctgtgcctccttacccaatttcctttagaaggacttggtagtgcctctgtggatgtggtacctcttatcaggctgtttgtctgacttgcttcagagcaagtaaacaaacccaaaagatcaaaccatctgggttcccagaggttcctgcagctcctctgcactttattattcttgttcagaactcaaggacaaataggtcagatcatgaaatcagcccagtactagggactataaccttttggctaagacactcacagaagaagtaacttcctcggttggggaagaagaagatttagcctaggccagtggttctcaaatttagtgactgtaagcttcaagactagtcatgagctaaaaatatatttttgggagactcgcttcagacttactgaatcagaatctctggggttgggccaaggaaactgtctttcaaacactcattcccagatcattctgattccagtgatctgtagattgcatggagcagtataactagtcagtggttctggtctgtggtggtggctggcagctgttttggggttgtgggggacaggtcagataagcttctccattcataatcctccagcccagtaggcttgcaaaatttgcaccatgcttggttttcaattcaggctatttctaggttaatttcttaattgagctatttagctcagcagaggacctgagataccacagataagagagcggtttaggagtaagcattaaatatctctgactgtgtctcttattatcctttccagtcccacttatctgaagagccagatttctcaaaggacaagtaaccctagaggggagtatcaatgggaaagctatggattccttgccacatccccgttacagaactatgcttgttaagaacagaatctcaagaaaacatatcaagaggttgaatgaagacatttctctcttctgtattcctgatctcctggggttacaagagcacaggtttaggcaaacatagccgatttctctctaaggtgtctcttcacttcttgatgcactggagatccttgtggaataatacattagtgataatgagtgttgggtgctcacaaatcacccacaattcattggctgaaggcatcttaaacgtggactttttggcttttattgtctttagctgcttcttttaacatactttagtttgagtgtacagatttggggttttcaaacttgtttttaattaaggcatggtttatttttattgcttgagataaaatgcagtctgagggtcacaaatgtaatttacaaaataaagtgcatctgggcagaccataagaaaaaaaaagaacagaaagcctaaataaagagtgggccaggattcttaagtttatttagtaacttcttggagaataaaaatcccagcacctgcattataaaaaagcacaccttataagtgtccttctcttcgaaacacctaagtgaactacactgaattatgaactaactaatggtttgtaaaaattcgccttgagcaagctattgaagatactaaataaacgaggctgagacagagtctgaggaaacccaacctgctgtttgttttatcagtaatgtaactcaaaagtagccaagcggatggctggagttttctctgtgttttgtttccctgggctgagcctgtgaatgccaagatttaatctaaagaggtttgtgttttaaaaaactaacaaccaagtaataaaacacctataaaaactgtttataatggaaccggtgacagtttgtagtgtagtattacaattcttctgctccccctcgacctttctctatcctttcatccaactctgtgccctttgtctaagttcctttctcaccttgctgccaagaagctcaggaggagagggagctcacaccccaaagcagcagaccatctttaaaaaatgaagtgtgtgttgtggtctgcatttgaagacagggctgcgtgtgctgcttgttttgtctgagataaggacgaagataagttgtcctaacaaagtacctacctagttgtacagtggtttctaatgggaaggtgaagatgccgctgcagtgtcagtggcatgaggctgcaggagtcaaccagggcaggaagcctggggcctcccctccctggcacccggcatagccatgcccaggcccaagatggccctgactccagggacagacttcaggcaacaggtggttttccacccaggccaccatgcctgaaacttggttcttttgcaaagccatagttctcctccccctctcaaagaaatggcgcctgggagggaaacttcgtgctcaaactctctaggagccatttctcagcccacctttcctattttctgaagtctcccttgccagcatcccattcacctccggaaagaaccaggggcgctctcttcagagtccagagagctctgggaggcatgtgggcagcgtcagagtggcctcgcctgggcggccagaggagcccccagtctccctcaagtgggcctcaggaactcggggggcccaggggaagcctggaaaaccgaacttcgccatcagccttccttacagcgctggctaaaagagagggggggaagggccccccagcggtcttccccgcccccctcccgcctcagcccctctgccatccgcctgcaccgcccaagaaagcacccagaacgcggctgagctcgccagctcctcgcaggcagggagagagcatcctggggggcagcttccccctccagcccgcgtctgacatccccactcccacacaaggatgccgccgccgtgccctgtccgcagtcgctgaatgtcactgctccctcttcctcccgatcagggtagacacagctcccgaggcgtcccccaccccaaaactgccgcgatcgcccgaaggcgcaaagcctgggcgaaggacgaagtttggggcccacagcgacgggagtggggacgcgttggcgaggaccgcacctcagtcccagccctggcgggcacactccccgccccaaacggcccaggcgtccccatcctcccgcggacaccagcgtctccgccctcccccgagggcggcgagaggagccccccggggcggaggcaggtacccccggggcggagactggggcgggcggggtccgggctgcgcccccggccaggccgggcgggctggcgggcggcgcggggggagcggggctgggcggcgctgcctcgggctctgtgcgctgcagcccggagccgaggaggaggaggcggaggaggagaaggaggcggcggcggtgggtcccgggcggggggagcgcggcgctgcggacccgggcggctggcaaaggacgaggcggaggctgaggaaggcagcggggagacccaggctgcagcaacaaagggcagcgagcgattggccgggctgcaggcgaggttagccggggacccgggtggccggaggcagcggcgagcggtgcacgtgcttgcagacacgggcgagtgtggagccggggggtgcacgcccggtgggtaggggcttgctcccccgaggcatgggatggcgaggaggctgcagcgacatcgttctgcctgcacccggcctggggctggcagggtaggggtgtgttggggggggaaggatgcgagccagggggcgggcgagtagtcgcccgggacgggacgggacgggagagagggtggaggagggggcgggatggaacgctccgggcggcgcgcccgtccgcacactccaccgaaggagctggcgactgagaacctcgaattttaacttcgcgtgcccgcccgcgcgcgcccgcccgcgcccacccctaaatcctgcggccgccgccagcgatcagctctcacacaaactttagctgcgggctagggggtttggggttgagtgggggaggggagagggaaaaggcctcctgattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaataaatagttttatgtggctgggtgtggtggctcacgcctgtaatcccagcactttgggaggccgaggtggatggatcacgaggtcaagaaatcaagaccatcctggccaacatggtgaaaccccatctctactaaaaatacaaaaaattagctgggcatggtggcgggcgcctgtagtcccagctgctcaggaggttgaggcaggcgaatcacttgaacctgggaggcggaggttgcagtgagctgagattgcaccactgcactccagcctggcgacagagcgagactctgtctcaaaaaaaaaaaaacaaaaaaaaaagaaaaatattttatgtaagtagggatgtgtaagctgtagtgatcagtctttgttgcagaatggtaaatgatgcgtggatgagagaagtggggtgatgggatatttcttccctttaatgccttaatttgcatttccaaagcacctttaagcatctttttatagaactcccatgatcttctgatacctgtcttctcgcagaccccagaaagagaatacaccaattttcgtatcatctattccattgttgccgaatatttgagttgtttcaagtttggggcaattgtgaacaaagctgctatgagcattcctatacctgtcatctggtgcccatgtgcacaagtttctctaaggtatacacctaggaatgaaattgccggtttatagctagggtgaccatttgtcctggtttttgcttattttcccagcgtaactgtaacacttttagttttcaaaagtatctagggttagatgatgaattgtatggtcacctagtcataaggtatgcttgtcttcatctttactaagtaccaaactcttctaaagtattgtaccaggttacactccctccagcaatatatgaattcccttgcttctcgccctctccaatctcagcctttttagcttttatgattttagccaatatggtaaattttgcgtttacctgattagtaatcagattgcacagctcttcatatatatatatatatatatatatatatatatatatattttttttttttttttttttttttttttttttttttgagacggagttttgcttttgtcacccaggctggagtgcagtggcgtgatcttggctcactgcaacctctgcttcctgggttcaagcgattctcctgcctcagcctcctgagtagctgggattacaggtgcccactaccacaaccagctaattttttgtatttttagtagagatggggttttgccatgttgggcaggcttgtttcaaactcctgatctcagttgacccgcccgtcttggcctcccaaagtgctgggattacaggcgtgagcctctgcacccggccagctcttcatatacttttttagccatttagatagcctcatttataaagttctgttcaagtctttcccaccctgcttttaaaagttgggccttgtatcttttattgctatttagaagttctttatttactgtgaatacaagtcctttgtcatgtgtgtgtgttgcaaatactgtggcttgccttttcactctctttatggtgtcttttaatgaacagaagttcttaattttaatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatggcgtaatcttggctcactgcaacctccacctcctgggttcaagcaattttcctgcctcagcctcccaaagagctgggattacaggcatgcgccaccacgcctgctaattttttgtatttagtagagatggggtttcaccatgttggccgggctggtctcaaactcctgacctcaggtgatccacctgccttggcctgtcgaagtgctgggattataggcataagccaccaagcctggccttgtatctctattttaaaaagttttttaaaaatcacattttttggccgggcatgatggctcatgcctgtaatcccagcactttgggaggctcaggcagctggatcacaaggtcaggagctcgagaccagcctggccaacatggtaaaaccccgtctctactaaaaataaaaacaacaacaacaaacaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttgccatgttgcctgggctaagtacagtttagaaacaattgaaacatgcatgttaggaaaagttatgctcctcttgtttggataccatgaacccttgaaatggaacctgttttcctcaatgctttagatcagatcagcccatggaaaggcaaaccacctggtcctacaaattggataggaccaggtggtttgcctttccatgggctgatctaaaaggctggagtgcagtggtgtcacctcggctcactgcaacctccacctcccgggttcaagtgatgctctcacctcagccacccgagcagctgggactacaggtgcacaccaccacgcccggctaatttttgtactttttgtaaagatgaggtttctcgatgttgcccaggctggtctcgatctcctgggctcaagacatccttccgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggcgtgcactcttgcctccacttcatgtccctttactcactagttgaagaactgaagaatggatttggcactaatagcttcagagtttttaacaatagaagtttggatgggcaatttttttttttttttttttgagacagggtctcactttgttgcccaggctggaatgcagcggtgtgatcatggctcactgcagccttgacctcctaggctcaagcactcctcccacctcagggtcctggaactacaggggcgtgtgccaccatgcccagctaatttttgtatatttgataggcatgggttttgccattttgcccgggctggtctcgaactccttggctcaagcaatctacccaccttggcctcccaaagttctgggattacaagtgagagccgctatgcctggcccaaaatgatttttgagaagtacatttaaagttgtagagaagggtctttcatttaaatgcccacagggtgcatgaaaaatacaaggtgatttatcaagataggctctttggctcatgcctgtaatcccagcattttgggaggccgaggtgcatggatcacttgaggtccagagttcgagaccagcctgggcaacatggcgaaaccccatctctactaaaaatgtaaaaattagctgggcatggtggctcacgcctgtagtcccagctactcaggaggctgaggcaggagaatcgcttgaaccttggaggtggagattgcggtgagccaatattgtgccactatactccagcctgggcaacagagcaagactccatctctggaactcctgatctcaagtgatctacccaccttggcctcccagagtgctgggattataggcataagccagtgtgccctgcctttgatgatatttcaaagactaagtaacatctgaagaattttatgtcttttatttatttatttagacaacgtcttgctctgttgctcaggctggagtgcagtggcacgatcttggctcactacagcctccacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcagggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgagctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaatttttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatata

SEQ ID NO: 85 - DNA, 4320 bp, Homo sapiens
gcaaatccactttctttttacttcccactttttccctttcaagttctagtctctttgaaatatgagaaggtaggaaggaattgatgtgtctgcagattgttgtcttacaagtaagaacaggtggactgggcggccaagctgtcacagcctcgtgaggctcggggtccccttctgtaaagccaaggggttgcacagtggcctctgggattatttcttgcagttcctccctggtctgtgtttccatgagtaggtatttgttctctgctgaattggctactgttaatacctgcctgtttcctggaacctagcgaggatcagaaatgctggtggaagttgagggctggtggctccagcctggctgcccagcccaactgtttccctctgtctctgagccaggtggggtggatggaaagtataacacagcagcttcatggccaaggggttggggagtggtgagatgtgtttggggccagggcctgaaagaagtctctggagtcctgggcacagtccaggttctgttccagcttgtcatggacctttgccttctgtggccctgtccagcctccagattgcaatcacatgcacttgttctgatcatccttgggttatacagatgaggcaggggaggcccagagaggccctgtgacatgcccaaggtcacacagctatgtagcagacatgggactaacacccagttctccctactcctgggctggctgtaccgctcagcttctctggaaagataagaatgtacaaaagttctctctaagacttggctgtcacatctgtaaagtgaaagaatttgactagattagtgattctcaactctgcctgcgcaatagcgtcacccatcctgcagactgaagttccggagcccaggcagctggtctttagagggggctgccgacttggttggaaaaagcaacagcaatcacacatgaagcagctgcctgttcagggggagcctctgcagtcctgaagacatttcacagggagcattggggatgtcacccaggctcaaggtgggctcatctgaagcctggcacctgccatgacagctgagcacagggcacagaggcacagttagttagctgagtgacatctttagtgagtggtctgtgctcacagagctcccttgccttctcatcctggggagatggctggcctgccttcagctggagagtttgctggtaagatattttaaaagaaactgtatttttctgttctttttggggtctttaggattcctcggctactgggccctttgtcaggagaataattcatggactcagctcaggaaaccttagtgcctatgtgtttacgcagagggctgggcgaggctctgtggaggactgggtggaaatgcttctgtcctcagggagcttccaggcaggaaggtgaggggctcgtgggaacagaaccgcattatggggtgggccgcagtgggcccaggagttggcatggtcgtgatctctgaatgcagtgagcagaaaacctgtaatttttttttttttttttttttgagattcagtctccctctcgcccaggctggagtgcagtggtgcactcttggctcactgcaacctccgcctcccgggttcaagtgattcaactgcctcagcctcgaaagtagcctcgaaacacacccagctaatttttgtgtttttagtagagatggggtttcaccctgttggccaggctgttcttgaacccctgacctcaggtgatccaccgcctcagtctcccaaagtgctgggattacaggcgtgagccaccccgctggcctgtttttctttttaatgctgcccctgcctctgtcccaataaatgccattttttaaatgcaagtagatttttctttaattttgtctactgtctttctttctagtctaagtcttgtttctgtctctggtggcaaaacagcagcggcagactgtgccagacctaatgagagagatttgtctggcagcttttggctgtggagctgactgctggcacattgacttagaatctccatgagtagagattgaggggaggagggagtattaggtgagcaggagctgtctgctcaaagatatggtatggggagagactagtttagtttgcatgggggactagtgaacgggaaggagccgggaaagacagagctggaaccagccgaggcagtgctgagttagtaggttgaccaataacgtgggtcattggtgtcactcccccagactgaaaccctcttttggcgtctctcttgtcatcactttcctggcagttgcaaaccttgagaccaggtgccctgtactgtgtgattcctcctggcctccctgctgaatctccttcacctctctccacagcagcccccatgctcatctgccattcaggttcaaacagttctcctgcctcagcctcccaagtagctggaactataggcgcccgccagcacacccggctaatttttgtatttttagtagagatggggtttcaccatgttggccaggctggtcttgaactcctgacctcaggtgatcggcccacctcggtctcccaaagtgctgggattacaggcatgagccactgcacccggcctgcttgtgttccttcatctgccccacttccgtgacctggccgctcctgggctctgcccctctagctttgtttcctctgtgctgtcactgcacattgacatttacaaagcatctgagtgtacctctcttctgctgctagacacctaccaggtgcagttgcagagaggatgttggcttttccaaatgtcccttctggggatcccttattgtcttccatcatggttggttcactgttcagcaatcctgtggcctcctcagtgtcttatccccaccctccaatttcatttcccctcccctctctcctctcccctctcccccctccccgtcccccctccccgtctctccctcccccgtccccgtctcccccctcctctcccccactcccccctcctctccccactccccccagttattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgaggtaattggggggtttctttatgttatccgtctggtaatttttgagatgcaagaatcatcactcccccacattctaggtttctctgatgttacctgtttagtcaagtcacttaatgtggagattgagcctcctcccctctcagcattttaatggctgcttctggtgttttctctcctagtgcccccatctctccctctccaggaagtccatgtaagcaaagaaaccatcgggaagatttcagctgccagcaaaagtaagcccaggttcttcttaaccctccagatgcccactcagacctctgtgtgatggactggatgagaaccatgttcttccagagagtttctgcccctttcccatcttcctttcatgctctggccagagtcattttccccaaacagggacctgaccaaatcacttggtttaaaaacaaacaaaagtgggtgcctgtaattccagctactcgggaggctgaggcaggagaattgcttgaacccaggaggtggaggttgcagtgagctgagattgcgccattgcactccagcctgggcaacaagaggtacactccatctcaaaaacaagcaaaacagctcagtaaacctttttttgttttgttttaaagacagggtcttgctcctgtcgcccaggctggagtgcgatggcataatctcagttcactgcagcctcaacctcctgggctcaagcaatcctcctgcctcagcctcccaaatagctgggaccataggcatgcatcaccacgcctagctagtttttgtgtttttagtagagatggggtttcgccatgttacccaggctgatctcgaactcctgaactcaagcaatccgcccgcgttggtctcccaaagtgctgagattccaggtgtgagccaccatgcccagcctcagtaaatctttattattgaattacttggcctgtgcctcaaggttttctgttacctgctcaccaggtaacggggtggctacttgccatgtccatctcccaccatattccttcctcttccaccctcatcagtatccctccacattgctgctgttactgctactgaactcttgggtaacatggcctcacatatcagggtgcctgtgtccacactagactgtggtcccccgaggcctgggaccaagccttttcagtgctgctcactagcc

SEQ ID NO: 86 - DNA, 12014 bp, Homo sapiens
atacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgata

SEQ ID NO: 87 - DNA, 7566 bp, Homo sapiens
ttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaacactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtga

SEQ ID NO: 88 - DNA, 16376 bp, Homo sapiens
atacatagaaaagaaaaaaaaaccggggagagtttttaagtaggaaagtgataagacattgggggataagatggagacaagggcattaattagattgccatagtagtttaggcaagaggattcaatgctaacaagtataatggcagtggaagtggaaaagaggggatttaggttaggggtctccaactcacgtacagaaatcagctaagtaatgtaggtaagtgaaatgaactgagttgggactctggtgaactgggcagccctttcacagctccagctgattgttgccttgcgacaatattgtctctgtgtgatcagatagtcagttttcaaaagaatccagaagtccagaattgtgtatttactcacgttgaaatgttgaatttaaaattttttggccgggcgtggtggctcatgcctgtaatcctagcaccttgggaggccaaagtgggcggatcacctgaggtcaggagttagagtgaaggggtgggttgcccctccacacctgtggatgtttctcctaaggtggaacgagagacttaggaaagaaaaagacagagacaaagtatagagaaagaaataaggggacccggggaaccagcgttcagcatatggaggatcccgccagcctctgagttcccttagtatttattgatcattcgtgggtgtttctcgaagagggggttgtgtcagggccacaagacaatagtggggagagggtcagcagacaaacacgtgaacaaaggtctttgcatcatagacaaggtaaaggattaagtgctgtgcttttagatatgcatacacataaacatctcaatgctttacaaagcagtattgctgcccgcagatcccacctccagccctaaggcggtttttccctatctcagtagatggaacgtacaatcgggttttataccgagacattccattgcccagggacgggcaggagacagatgccttcctcttgtctcaactgcaagaggcatgccttcctcttatactaatcctcctcagcacagacgctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatctcgcaccgcccttaatccattgaaccctgagtttgacacagcacatgtttcagagagcacggggttgggggtaaggtcacagaatctcaaggcagaagaatttttcttagtacataacaaaatggagtctcccatgtctatttctttctacacagacacagtaacaatctgatctctcttgcttttccccacattagagaccagcatggccaacatggtgaaaacccttctctactaaaaattcaaaaataagccgggcgtggtgtgggtgcggtggcaggcgattgtaatcctagctacttaggaggctgaggcaggagaagtggttgaacccgggaggtggaagttgcagtgagccaagatcaccccactgcactccagcctgggggacaagagtgagtctcaaaaacaaacaaaaaaccaaaatatgcccgtgggccaaaggtggcctttgattgtgagtttgcaacctcttgtgagtgacatagaatctactagaaaagagggcattttaaaaaaagtaggctgggtggagcggctcacgcctgtaatcctgaagggggccagcccctccacacctgtgggtatttctcgtcaggtgggacgagagactgagaaaagaaataagacacagagacaaagtatagaggaagaaaagtggacccggggactggcgctcagcatacggaggacccgcaccagcactggtctctgagttccctcagtatttattgatcactatctctaccatctcagccagagggatgtggcaggactatagggtaatggtggggagagggtcagcaggaaaacatgtgagcaaaggactctgtgtcataaataagtttaaggaaaggtgctgtgccttgatgtgcacgtaggccacatttatgattgactttacacaaacatctcagcgcagtaaagagcagtattggccgggcgcggtggctcacgcctgtaatcccagcactttgggaggctgaggtgggtggatcacgaggtcaggagttcgagaccatcctggttaacatggtgaaaccccgtctctactaaaaatacaaaaaaaaaattagccgggtgtgatggcgtgcgcctgtagtcccagctacttgggaggctgaggcaggagaatggtgtgaaacctgggcgacaaggcgagactctgtctcaaaaaaaaaaaaaaagcagtattgccgccagcatgtctaacctccagccataaggcggttttctcctatctcagtaaatagaatgtacaatcgggttttatacagagatattccattcccagggactagcaggagacagatgccttcctcttatctcaactgcaaagaggccttcctctttcactaatccttctcagcacagaccctttatgggtgtctgggggacggtcaggtctttccattcccatgaggccatatctcaggctgtctcagtggagagaaaccttggacgatacccaggctttcttgggcagaggtccctgcggccttccgcagtgcactgtgtccctgggtactcgagactggagaatggcgatgacttttaccaagcatactgcctgcaaacacatttttaacaaagcacatcctgcacagccctaaatccattaaaccttgagtcaatacagtgcatgtttctgcgagcacagggttggggctagggttacagattaacggtgtttcaaggcagaataatttttcttagtacagatcaaaatggagtttcttatgtcttcctttttccacatagacacagtaacagtgtgatctctctttctttcccccacataatcccagcactttgggaggccaaggcaagcagactacttgagcccaggagtttgagaccagcctgggcaacatatggagcccgtctctacaaaaataaaaattagctgcgtgtggtggtgcatgtgtatagtcccagttctgggggaggctgaggtggggaggattgcttgagcccaggagttcaaggctgcagtgagctttaattgtgcaacaaatagaggccctgtctcaaaaaaaaaagagggtttcactcttggtcactgtaacctcaaactcctgcacacaagcaatcctctgggctgagctgggactacaggcatgggccaccgtgcccagctaatctattttgctttttgaatagacagaggtcttgctgtgttgcccaggctggtctcaaactcctgggctcaagtgattctccagccttggcctcccaaagcaatccctaggtaacagactcagtctggcttcctggctctggcttcttcccttctagttcattctccacactgtagtcagagtgatctttacgaataaaaactctggtcggtcgggcacagtggctcatgcctgtaattccagcacgttgggaggcctaggcgtgtggatcacttgaggttgggagttcgagaccagcctgaccaacatggagaaaccccatctctactaaaaatacaaaatcagccaggcgtggtggcatatgcctgtaattcgagctactcaggaggctgaggcaggagagtcgcttgagaaaggcggaggatgcggtgagctgagatcgtgccactgcactccagcctggccaacaagagcaaaacctctctcaaaaaaaaaaaaaaaaaaaaaaagtctggtcaggtcccacttcagctcacaatcagttcagtgcctctccattgtctttaagctatagcccaaattgatcaatacagccattaagaagtgctgctaggccaggcgcggtggcttacctgtaatcccagcactttgggaggccaaggcaggcggattacctgaggtcaggagttcaagaccagcctgggcaacatggtgaaatcccgtctctactaaaaatacaaaaattagctggacatgttggagtgtgcctgtaatcccagctactcgggaggctgaggcataagaattgcttgaacctgggaggtggaggcaacgatgagctcatcgcaacgatgagctgagatcacgccattgcactccagcctgggcgacagagtgagactctgtctcaaaaaaaaaaaaaaaaaaaaaaaagccctgcttctaacagggccaatggctcacacctgtaatcccagcactttgggaggcgaaggtgagagggtcccttgaggccagaggtttgagaccagcctgggcaacatagtaagatgaaacccccatctctacaggaaaaaagcccttcctccctatcgccacccctcccccaagcctaaactaccccttctcacccacagtcaactccctggggtttgattttatctaggtaaatcatcctgctatctctattgtctagcagaatacaattcacaaataggactcaatatacatttattagttacctctataagtttttttcagtttgcctctttatgttgggaatgctgtaaatttttaaatgatcttttctcagccaattcattgactgtcctaccttaccaaatgattttgctcttagagaggtctggagagtgtttgttcaaggagcaaccctgcccccacctggcagcaagaggcactgcctcaattaatagaggagaaggatatgcaaatgaccagtgcttgtcagggaactggcagagacgtgacagtggagaaaaggctcaaattctttttgagatggggtctcattctgtcacccaggctggagtgcagtggcgtgatctcagttcactgcaacctctgcctcccaggttcaagcgattctcttgcctcagcctcctgagtagctgggattacaggcgctgcaaccactcccagctgatttttatgtttttagtagagacggggtttcaccatgttggccaggctagtctcgaacccctgaccttaagtgatcagcctggcttagcctcctaaagtgctgggattacaggcgtgagccaccactctgggcctcaatttcttttctttttgaaccaggatctcactctgtcacctaggctggaatgcagtgtgtgatcacggctcactgcagtgttgaactcctgggctcagaggatcctcccacctcagcctcctgagtaactgggactgtaggcatgtgccatcacacccagctaattctttaattttttggagtgtgacagtgcctcactatggtgcctaggcgggtctccaactcctgggctcaagcgaccaaattgctgggaaacaggcatgagccactatacctggcccaacataaatagaatttcctgggttgtggaggagtgtgacattgaggtggtcttccagggaagaggtgcttttacaactgcagtgggtaacatgggtatctgggctacctgctcatgcaatgtactaatgttttctggttctgctttcagcttcatcatgaatataccatttccatctttatatctgactaaagggtctgtctgactttatgacttgataggtctgacaagacccaattcataatggggcagttctggatgcttcatagtcaagctttccagtaacagccctgatgctgtttctcaaaaggcacctacttccctgctttggacagcttggccttgctccagaatctcagggacttgcattgtgcttttgccataggagcttgccataagttctacactgaatctttttttcgctactgatactttgaacccccaggatctgctggattgcatggcttaagtgtgcattgcatcctagacttgatgcagagccctttcctgctcagagtttgagtcaaagttggcagcttagccggtatgtgggctggagatatatttctaagtctggatgtgacagacaccacacccgtgcattctttttgtctttaatggtggcactaatctctgtccctccccaggatgtgatactgcttttgatttactatcatagctgaagagagggaggggttttagagatctctttgtctgtcccactatgataggtcttacctcttaggccaaggacccaatgcgattacttcaactcctaagtatatcaatcctgttaaatacttggttttttttttttttgagatggaatgtgctggcttgcagtggtgccatctgggctcactgcaacttccaccttccgagttcaagcaattcttggtcctcagcctcccaagcagctgaggctataggcgcgcaccagcacgcctggctaattattttttttatttttatttttatttttgagacggagtctcgctctgtcgcccaggctggagtgcagtggcgcgatctcggctcactgcaagctccacctcccgggttcacgccattctcctgcctcagccttgcgagtagctgggattacaggcgcccaccaccaagtctggctaattttttgtatttttagtagagacggggtttcactgtgttagccaggatggtgtcgacctcctgacctcgtgatccgcccgcctcggcctcccaaagtgctgggattacaggtgtgagccaccacgcccggccgctaatttttttttttgttttgagacagagtcccactctgtcgcctaggctggagtgcagtggtgcaatctcggctcactgcaacctccacctcctgggttcaagcaattctcctgcctcagcctcccatgcccagtccccgtttaaacacttggaactgaggaaatatctagtgatgggtccatggacaagcagacttactatgagctagtaagttttggctaggacttcagttactgcctgacacctgtaagtccccactgtaatgtgggaatcatgatgaagctttgggtttccaggtctcaatgtcagctcagatcttgtgcccaaaatcctcaaagtgtttaggcatttccctttacccagtgtaccgttatctgagtaagtgatatgttgacattctcccttttaggaggaactggcagaaccgttacagttttagcatcctttcgtagggatttgtgtacctcttcagtaattgagttttggatgtgaaagttgtttcagccaggtgcggtggctcatgcctgtaatcccagcactttgggaggctaaggcagtcagatcacttgaggtcaggagtttgagaccagcctggccaatgtggcgaaaccccatctctactaaaaatacaaaaattagctgggcatggtggcgtgtgcccgtaatcccagctactagggaggctgaggcaggagagtcccttgaaccctggaggtggaggatgttgcagtgagcctagattgcaccactgcactccagcctgggcaacagagcaagactctgtctcccccacaaaaaaaaaaaaaaaaaaaaaagttggcttagatccaggagctgaatcaaggattttgcctgtttattgtggtgattgcccttagctgcctcttcctcctctattcttgcctttttctgtttgtagatgcttagtagcatcctttttggctatccgcatatttttcccctaaggatgccatgctctattgtatccacaactctgtgaatcaaacgcctcatggctacccctgcaacattgacagttttatggtagttgcatatttctggcttttggcagctaagcaatgctacccagcctctgttacgtgttgggagatacttccccgtatatcttgagtagctcagctctgactgcttctcctgtcatcagctgtggactgctcagaagccaccactgaatttctaagtgatgctgatgtccaccgatgtcaccagtatattcttgatggtcttgtaaatgtgtccttcgggtcctttcttggaacaccattctctggtctcacatagtacagtatagtacgtatatctattccagcatgcccacttttttcagccactttttttttttttttggatggagttttgctcttgtcgcccaggctggagtgcaatggtacgatcttggctcattgcaacctctgcctcctgggttcaagagattcttctgcctcggcctcccaagtagctgggattacaggtgcctgccgccatccccagctaatttttgtatttttagtagagacggggtttcaccatgttggccatgctggtcttgaactcctgacctcaggtgatccatcctgatgggaatgttaattgtggtagtttctttgcttttttttggcaggtgggggggtggtctcactctattgcccaggctggagtgcagtggcacgatcttggctcactgtaaactctatctcctgggtccaagctactctcgtgcctcagcctcccaagtagctgggattacaggtgtgtgccaccaaacctggctaatttttgtatttttaatagagatgggccttcaccatgttggccaggttgattgcaagctcctgacctcaggtgatccgccctccgcagcctcccaaagtgctgagattacaaggtgagccaccgcatctggccctgcttttttggtctgtgagccagaatagtatctgttcttatcctctaacatctcatcagttctgtacttgaggatactttatcagatagatttttggaacagggagattgaataaaaacttaaacttgctcatcctttttacaagtcaatatagtattgcattacctccatgaatgctgtggttctaccttttggggcagatgtcagttaaaattcagactgtcacattccaccgtatcttttggtttctggaaaaaactttaaggtgaatctgctatttcttttttcttctttttctttttctttctgtttttttgagatggagtttcttgttgtgcaggctggagtgcgatggactgatctcggctcgccgcaacctccgcctcccaggttcaagtgattctcctgcctcagcctcctgagtagctgggattacaggcatgcgctaccacgcccagctaattttttgtatttttagtagagatggggtttctccatgttggtcaggctgatcttgaactcctgacctcaggtgttgcgcccacctcggcctcccaaagtgctgggattacaggtgtgagccaccgtgcctggcctatttccctttattctttctcttttcttttcttttttttttttttttttttttgatacagagtctcgctctgtctccaggctggagtgcagtggcccgaccttggctcactgcactctccgcctcccgggttcaagctattctcctgcttcagcctcccgagtagctgggattacaggcgtgcaccatcacacccagctaatttttgtgtttttagtagagacgtggtttcaccatgttggccaggatggtctcgatcccctgaccttttgatctgcctatctctgcctcccaaactgctgggattacaggcgtgagccaccgtgcccggctgcttccctctttctttaaatttaatttaatttttaaaattaagatgtttatctcactatgttgcccaggctggtctcaaactcttggccacaaacaatcctcccacctcagcctttcaaagtgctgggattataggcatgagccaccatgcctgaccccttttttctttaacattatgtttttgacacatttttgcctatcttttatgtcctggttctttcaaatttagtcatttctagtattctagttagaaattttctacaaattattttacaaatgttctacaaattatttttcaaaaaaaattttttttttttgagacagtctcactcttgtcgcccaggctggagtgcaatagcatgatcttggctcactgcaacctcttccacccaggttcaagtgattctcctgcctcagcctcctgagtagctgcgattacagcctcctgccaccatgcccagctaatttttgtatttttagtagagacggggtttcacagtgtggtccaggctggtctcaaactcctgacttcaggtgatctgcctgccttggcctcccaaagtgctaggattacaggtgtgagccaccacgcctggcctatttttcaaatttccaaatttttactactataaccagtgctgcagtgaaatcttttatatattgttttgtgtacatgtgtgagagtttctctagggtatgaatctagctaggactgttggtgggtaaaagggtattttcattcttttttttttttttttttgagatggagtctcactctcttgcccaggctggagtgcagtggcacgatctccactcactgcaacctctgcctcctgggttcacgccattctcctgcctcagcctcctgagtagctgggactacaggcgcccgccaccacgcctggctaattttttgtatttttagtggagacggggtttcaccatgttagccaggatggtgttgatctcctcacctcgtgatctgcccgcctcggcctcccaaagtgctgggattacaggcgtgagccaccgtgcccggccaagggtattttcattctataggcggttgcaaattgctctcctagaacggatgtaccaactaatgttgccacttatgcaatttgtatcctcctaatcacttggtttagtcagatgttttcatattgccaatctgacggacatgaaattctattttcttgccattttaatttgcactttccagattactaatgaggttttgtaatctttaccattcttttgtatatctaattttgtgaattggcttttttgtttttgagacggtctcattctgtcgcccaggctggagtgcagtggtgtgatttcagttcactgcaacttctgcctcccgtgttcaagtgattctcccacctcagcctcccgaatagctgggacgacaggcttgcaccaccacgccccgctaatttttgtatttttagtagagacagggtttcaccatgttggccaggctggtcttgaactcctgacctcaagtgatccacccaccttggcctcccaaagtgctgggattacaggtgtgagacaccacgcctggcctgaattggctatttctattatgtgattagaatagaatttctatttggtgggtgccgtggcttacatctgtaatccctgcactttgggaggccgagatgggcggatcacaaggtcaggagatcgagaccatcctggctaatacggtgaaaccctgtctctactaaaaatacaaaaaattagccaggcgtggtggcgggcgcctgtagtcccagctactctggaggctgaggcaggagaatggcatgaacccaggaggcggaggttgcagtgaggcgagattgcaccactgcactccagcctgggtgatagagcgagactccatctcaaaaaaaaaaaaaaaaaaaaaaagaatagaatttctatttggtgattttttttcttgatgattattggtttttttcgtactggtttttagtgataatttatatgtttcatctactttgttagctatattagtttcagatagtatgtcttctatttgtggcttgtcttttcagtttgttatggcaaattgtgatgcataattttttctcttttaatgttgcacaatttatttgtctttttcttcatgatttattcttttgtgtattttttttttttttgagttggagtcttgctctgtcgcccaggttggagtgcagtggcgcgatctcggctcattgcaacctctgcctcccgggttcaagctattctcctgcctcagcctcttgagtagctgagattacaggtgcctgccaccacgcccagctaatttttgtatttttagtagagacggggtttccccatgttggctaggctgctctctggccaggcttgtctcgaactcctgaccttgtgatctgcccgccctggtctcccaaagtgctgggattacagacgtgagccaccgcacctggcctcttttgtttcttctttaaaactcttttcttatcctgaggtcagaaagatattcttatttttttctgaaattttatttatttacttatttatttatttttttttgagacagagtctcactttgttgccagcctggagtgcagtggcgtgatctcggctcactgcaacctctgcctcccaggttcaagctattctcctgcctcagcctcccaggtagatgggactacaggtgtgcgtcaccacgcccagctaatttttgtatttttagtagagatggggttttttttaccatgttggccaggatggtcttgatctcgtgaccttgtgatccgcccgccttggcttcccaaagtactgggattacaggtgtgagccaccgcgcctggcctatttgattacttagaatataattttgtgattggtgtgaagtagtgatctaattttatttttttatagtaccatttggtaaatagttcattctttccccactgattatattatctctgtcgtatattgtttcaagtatgcatgagttatttttaggctcgttttctgttccgttggacacttgcccatccctgtgtctttagcatactatgattgttactttatacattattattattattatttttttttttttttgtagagttggggtctcactgtgttgcccagactggtctcgaactcttggcctcaggtgatcctcttccctcagcttcccagaatgccgagatgataggtaataataataataataattattattattattattattattattattattattatttgagatggagtcttgctctgttgcccaggctggagtgcactggcgcgatctccacttactgcaagctccgcctcctgggttcaaggttcaggtgtttctcctgcctcagcttcctgagtagctgggactacaggcgcccgccaccacgcctggctaatttttgtatttttagtagagacgagtttcagcatattggccaggctggtcttaaactcctgaccttgtgatccgcctgccttggcctcccaaagtgctgggattacaggcgtgagccattgcgcccggcctgattacaggtaattattcctttagcaaataacatgcctgctgcctggtagggcttatcttttttttttttttttggtgtgaagtcttgctctgttgcccaggctgcagtgcagtggcgtgatcttggctcactgcaacctctgcctcccaggttcaagcaattctcctgcctcagcctcccaaatagctgggatttcaggcacccgccaccatgcctgactaattttttgtatttttagtagagacggagttttgcctcattggccagcctggtctcgaactcctgatctcaggttatccgcccgtctcggcctcccaaagtgctgggattacaggcgtgagccactgtgcccaaccatactttatataatattattattattattatttgtagagacggggtctgactgtgttacccaggctggtcttcaactcttggcctcaagtgatcctcctgccttagcttccaagaatgctgaggttacaggtaattattattttagcaaataacatgcttgctatctggtagaatttgtctttaaaaatacgattttttttctttaaagatatctttactattctctgcccttttctcttgcacatgaattatagagtcatcttacaaagttctcaccaccagatattaagatttgtattagaattgcatttggatttttagattgtttggggagcactaatttctttatgacatcaaatctttattttattattattattattattttttgagatggaatcttgctctgtcgcccaggctggagtgcggtggcgtgatcacagctcactgcaacctccgcctcctgggttcacgccattctcctgcctcagcctcccaagtggctgggactacaggcacacaccgccacgcctggctaaattttttttgtatttttagtagagacggggtttcaccatgttagccaggatggtctcgatctcctgaccttgtgatccgtctgcctggcctcccaaagtgctgggattacaggcgtaagccactgcacctggccctctgcttttttaaaaaaagaattcattagctgagtgcagtggctcacgcctctaatgctagcactttgggaggcagatcacttgaacccgggagttcgagaccagcttggacaacatgacaaaaccctgtctctaccaaaaaatacaaaaattagccaggcatggttgcatgctcctgtaataccagctgttcaggaggctgaggtgggaggattgcttaagctgaggaagtcaaggctgtagtaagccaagatcacattactgcactccagcctgggcaacagagagagaccctgtctcaaaaaaacccaagaaacagaaaacagaatttgtctttagtttctctatagtccagcctccttttaagagacttggtgttgaaattaaccaattttttctttctttgagacggagtttcactcttcttggccaggctagagtgcaatggctcgatctcggctcactgcaacctctgcctccccggttcaagtgattctcctgccttattctcctgagtagctaggattacaggcatgtgccaccacacctggctaattttgtatttttagtagagatggggtttctccatgttggtcaggctggtgtttaactcctgccctcaggtgatccgcccgccttggcctcccaaagtgttgggattacaggcgtgagccactgtgcctggcctaaccaattttttagttgcagaatgagtgatatttcaaattcaattttctgttacagcataccatactctaaatatctacttctcaatattttatattctctttcaccttattgattataaaatatatatatatttttcagacagggtctcgctctgtggccttggctggagtgcagtggtgtgatctcagcttactgcaccctcaacttcccaggctcaagtgatacctcccacctcagcctcccgagtagctgggactacaggcatgtgcaaccacactcagctaatttaaaaaattttttgtggccgggcctggtggctcacgtctgtaatcctagcattttgggaggccaagtcgggcagatcatgaggtcaggagttcgagaacagcctggccaacattagtgaaaccccgtctctactaaaaatacaaaaattagccgggcatggtggtgggcccctgtagtcccaggtactctgggaggctgaggcaggagaatcacttgaacctgggaggcagaggttgcagtgagccgagatcgcaccactgcacaccagccagggtgacagtgcgaaactctgtctcaaaaaaaaaaaaaaattttgtacagacaaggtctcactatattgcccaatctggtcttgaactcctgggatcaagtaatcctcctaccttggccttgcaaagtgctgggagtactaggtgtgagccaccacacccggccagctaattaaaatcaaacttttttttatagagacacggggtcttgctacgtggccctgtctggtctcaaacttctgggctctaatgattctcccattttggcctcccaaattacaggcgtgagccatggcacctggccaggctcatcagttatttgtttttttgtttatttctaatttttattttaattattttagaccagttctagctctgttgcccaggctagagtgcagtggtgcaatcataactcactgtagcttcaacctcctgggctcaagtggtccctcccacctcagcttcccaagtagctgggaccccaggtacttgcaccatgcccagctaatttttttttttttttttttttttttttttttttttttggagaaagagtctcaaataatttatgtagatcttccctctgcccagagatacagagtttaactctgtacatcttgagtgcaggctgcgcttagtgattctcttcctcagagtgtgatgacaaagttttggagggccaggggagggagaaaatgaggatgcagtattgtgtgatcatgactgcagaaatagctgctgttggagggcctcagtgatcattttaaggtctcttattgctacttatcttttttgatgagattaagtattctgtctctgatcagttgaatatctgatgtcattaatccaaggataatatgttaaaagtactaccccatattttccacatactgacctgctatttctctggtgtttatcttttagtatttggtttcatttgagagaatggcttg

SEQ ID NO: 89 - DNA, 12612 bp, Homo sapiens
aaatgtctttaaaacattaaaaaactttgtagtatcacaaataaaacagagggcaattctatactcatatacttttgattaaaacaatgcatttaaagcattctcagttaaaacagcaagaataatctcattaaaccttttaaccactccagcaggtaccactgttattctaatttacaaaggagaaaactgacaattagaaacttttccaaagagaccaaagtagctgatggctaggccaggtctagcaaacatataacttgacacataataatagctcaataaatggaagtcataattatttttcaactactagatcaatctcaggattaagagagaaggaaatcattctagagccattttctatttgaaaaaaaaagtagaagaaaatagaaatatgctcaaaatagaagagtagttgagtaaagaaaaatcttctgaatgggaattagagagtaaaacatatataattttccaacgctaaaagaaaaaaagacactattatatgatcaatccatagccagaaaggcagaaaaagcaggaacagaaacagatgcatgcaacagccttttactaaacccaaaggagactttggatatctattatctataatctattatagataggtagataatagatatctatatattatgtatctctaacctgttatctccctccctctgtccctccccaaggaagactttgtctctaaagcatttagaatcatataaaaaattaaccttaaatctaagacaaaggggatatggattaaattaagcatgtttaataatagttaagtttggaaaagttattttattcccaggtgcttttaattctgaaaatttgtctctaattgtatatttataaatacagtggttaataattttagtttcttctcatgctcagctatttttacattttttaaataatagttttgttatattcttaattatccgttccagaaatatggctatctggatcacaaagccatttacaaggtactgccatccatctggtaatggtaggaggaaataaacgttttgagttctgacttttcaacgtccaccttttatataagaacagaaatgccaagcatacaaaaaagtgtactgaatggtgaaagattagagtacacagcagaggctaaagtctatgttccagggacacagtcaacacttgataaatgtttgttggcacagggagggagggagggagggagggaggaaggggtaggaaaaagaaaggagattcaaaggagataaccacacacagaaattccgagatggaaaggggaagttaagaagtttaattagaatgtgtattttgtgtaagtaaggcaatatgtgccaagagaggtgtggtcaaacacttaccttaacccattagggaacaacttcttgtagtcaacatttattatactgatattgtttttagcaagggtttcaatggatactaaacggcccacatgctgaaaaccaggagccacggacctgacgtattgcctatcatgagctggcaaccaaaaaatctctaaggagaaacaagaagtccctcagtagataatcagctatccaggtacgaacagccccatagagaatggagggagctccattccagcacaggtagtattctacagagagtagagagagagagtctagtccttggtgaaagagtcaacatgggctagtattttctttgttttgttttgtttttgagatggagtctcgctctgtcgcccaggctggagtgcagtggcacaatcttggctcactgtaagctccgccacccgggttcataccattctcctgcctcagcctcccaagtagctgggactacaggcgcccgctaccacacccggctaattttttgtatttttattgtattttgtatttttagtagagatggtgttccaccgtattagccaggatggtctcgatctcctgacctcatgatccgcccgcctcggcctcccaagtgctgggattacaggcgtgagccaccgcgcccagccctgggctagtatcttctaatgaactcttataatggggctttcactagggctactctggagctgagttttctcatgacctctccatttaccagttaacatcaagtgtcaagggcctactgtgtacacaaagactcatacaagcaaagtagattagttgatagatatgggtgaatagtgagaatcaaaaacatctttctggttaatgatgttaaaaatcatctttgaggctgggtgtggtggctcatgcctgtattcttagcactttggaaggccgaggcaagaggatcccttgagcccaagagtttgagacaggcctgggcaacatagggaggccctgcttctattttatttaaaaaaaatcatctttgagaggagtcatttcctgccaacagagatgctattatgactcatctatgaaatacttccatttgtaaaaagacttataattgtttcactcacagcactcccatattctgagaatttatgggatttggaacaactgactgcccaaatgcagagttgcttctgaaaaacattacgagcaaatctctgctcaaataagaaccagctctcctttctatatcattcatcatgccaagtcttcaaagccttaatgttacccaggctctttctaatggatctatgttggtgtggtgcaggtcacattagatagttattacacatattcctctttaacagggtgctgacatttcatttggtttggaatagcaaacagcctcaatgattttccccactgagataaatttaactgggtcattcctagattaccacatgtagctgtataagtaacaatcttcatttccataggaagtaaaattacttaaggatcccagggtagatgtacaaggtaggtcaagttcaactactgtgctcctaggacatgctacccacctcccaacctatgtcataaatactgagatagacttaccagatgttgctcgattttagaggcaaggatcacgcttactacttggcggacaaatgtgtgtctgagaggatgttttggtggagggcgatgaagatcaaatatcacaaattttctttccttctctgcaagtgtcaataaatcagctagtgttggaattgactgatttcttgctctttctttatctgcctctgatagaggtttcatattgtaaaatggcctgagctagaaacaaatacatcaaaaaatacataaaagcactttccagttctcctactatgtagccacacatccagctctacctcagttgctccattatcattcaatccatcaggccctctgaagtactaatcctagaaaacaggtgacaaggagagaaataaaatgtaatcatcatcaataattacagtgtttggaatggtctcttctatatcctacaacctgttgtatttgcactgaaggtcatgttcttatcctgaccttcctttccagccttctctcccataagtcaagataatacatcccttttcagtcacgctggcttcctacatgggctcccgctattctagttttgtgtaataggaagaacacatgctttggcttcaactgaatttaataccagctctacccctcccttgacttccttgccatatccacttgttaaaatcctacccttcaaatgctatttccctcatgaagctttcctttaatcttcctgaactaaagagacttcaaggctggtgctgtgatcatgcctttaatcccagcaggctgaggcaaaagtatcacttgaggccaggagttcgaggccagcctgggcaacatagtgagacccttgtctctacaaaaaaattttaaaatagctgggtgtggagatacatgcctgtagtcctaactactaaggaggctaaggcagaaggattacttgagcccaggagtttgaggctgcaagtgagctatgattgtgccattgcactacagcctgggcaatagagtgaggccctgggcaatagagtgaggccctatctctaaaaaaatcaataaataaagagacttcaatggctttgaagcccaatggcccatttttatgcctctgtatgtctcattcatatatagctaatgtatgtaaaaatagctaagcatgagaagaaactaaaattattaacgactatatttataaatatacaattagagacaaattttcagaattagaatttggacatgtcttagtacattaaagttcaatcctggctcactatgcttcttgctatgcaaccttggtaataaaaccatttaaattctccaagtcatcattgcccaaattataaaatagaggagaggaagaataacctatatatttcttaggattattttgaagattaaatatgataaaaatatttacagggtctgggagtatgtctggtacatagatagaaaagtatacaattcacattagttccttcactctctgctgactctactggagtgtaactccctcttggtgggaactgtcatacattctttgaaacgcacagcatttcacctaacacatgggagaacacacatatgtttgctacattaaatttaatagatggcaactttgataatcacttgccattttttagatcatttgagtgaaggcagtgataaaaggctacctcccaggagaaggaagtagcagaaggaagaagtcacattttcttaagactcaagtaatctctctttttctctacacaactttatcttcattctctttcatacctctcctatttcttcttcttcttcctttgacctaaataagctgcctttttaaacatttttctcaggaaagaaacaatcacattgcacagtatctccggaaaattgctaggccagaaggcagatcattgctaggccagaaggcagatctaaaccatggtttagatctgattgaaagctacaactaatggttttcttaattctcaggacaatagaaatatgcttcagaattcaagattttgttagctactaccagacctaaaccaactggttcacttaactattaaaccttcttgtgagaaaaattgttaaaagaatttatgggaaagaccaacacaagaccaaaaattcaaaatagcaaagatggtaaatatttaatcaatataagagtttaaaactagactccagtaaactttaaatagtattatgggggtaggcctaacagctgaagtacattgtgcctctttagacttaatcagaaaaataaactggaatggataaatgcctgtttagactatattcaacatgtgattgaatgttttcaaaaagccacaggaagtaacaagctagaaatgaaaataaatttctggtcctccagatgaaacatctggttcctcaaataaaaataagattaaaaggtcctctgttctctgtgcctctgtgtagacatattacaaaaagaaaggttattggaagaaccaatgtataatattggttaagaaatagaaagacaagtccgggcatggtggctcacgcctgtaatcccagcactttggaaggccgagacgggcgaatcacctgaggtcaggagttcgagaccagcctgaccaacatggagaaaccctgtctctactaaaaatacaaaatttagccggctgtggtggcacatgcctgtaatcccagctacttgggaggctgaggcaggagaatcgcttgaaccgggaggcagaggttgcggtgagccaagatcgcaccattgtactccagcctggacaacaagagtgaaactccgtctcaaaaaaaaaaaaaaaaaaaagaaaagaaagaaagaaatagaaggacaattaaacctgtccaatgatgccacatcaaggaaacattccactgaatagacgattctgataagaactaactgtaactacatgtgaacaacaatacaattttcttttctttttttttttttttgagacggagtcctgttctgtcgcccaggctggagtgcagtggtgcaatctcagctcacttcaacctccgcctcccaggttcaagtgattctcctgtctcagcctcccaagtagctgggattacaggcatgcacgatgacgcccagctcattgttgtatttttactagagacagggtttcaccacgttggccaggctgatctcgaactcctgaccttgtgatccacctgtctcggcctcccaagtgctgggattgcaggcgtgagccaccatgcccggccaacaatacaattttcttgttgatatgggcaccaccacatctaccattaattgcattactataaaaaaatcagatcaccagagtactacaaccacttaagtagtgggagtatctaacaatcctgtctttttccatgtcccaatataaaactattactttgagaccattgtcagaagaacatctctttcttctctatggcactttccctgtacatttatttatttatttttaatttttatttttcttgagttttgttcttgttgcccaggctggagtacaatggcacagtctcagctcactacaacctccacctcccaggttcaagcaattctcctgcctcagcctcccgagtagctgggattacaggcacccaccaacatgcccggctaattttttttttttttttttttagtagagacggtgtcaccatgttagctaggctggtctcgaactcatgacctctcccctataaatttaaatattagaggctgggcaaggtggttcacagctgtaatcccagcactttgggaggccaaggctggcagatcacaaggtcaagagatcgagaccatcctggccaacatggtgaaaccctgtctctactaaaaatacaaaaaattagctgggcgtggtggtgtgtgcctgtagtcccagctactcgagaggctgaggcaggagaatcgcttgaagccgggaagcagaggttgcagtgagccgagatcacgccactgcactccagcctggcaacagaccgagactccatctcaaaaaaaaaaaaaaaaaaaattagcaagctactttgcaaaaagaaccacaagaagaaatgtactacagacaaattgtttttcgaagcctcagaaggttctatcgcacattatcaaattacagctcatatgaacgttactatattgattcaaaaaataaccaaatagacttctggtttctggttccacatgtaaggagcttggaagctgtcactccatcctaacaacaagtaaaaagttgaacagaatgaaaaatcaacaactcttattggatctgtaatagaggtgaggacacagggcaaactgctgcccagaaaattggagacacaggtgaaaggagatgaatcatagcttaccagaatgagcctaacaaatggaaaccactaaggaaaccagtgctcgggtaggaaaacttgaaccatcactgacaaattcctggaggattagtgtggacaagtctgagagttaaaaactcaaggggacaccttgagatacgtgattatgttgcttatttgaaatctttctacgttttttgatgtaggcatttattgctataaacttcactcttaacactgcttttgctatatcccataaggtttggtatgttgtgtttctattttcattcatttcaaaaattttttaaatttccttaagttcctcattaacccactgatcattcagaagcacgttgtttaatttccatatatttgtacagtttttaaaaagtataacatcttatttgtaaaaagcttaaatttgacataaaattttataaacacagtattatctgatttttacattttctcttttatttgagccaataaaatttatttttttaacttttattttagattcagtgagtacatgtgccggtttgttacctgggtatattgcatgatgctgagatttgaagtatgaatgaactcatcactcaggtactaagctcagtacctaatagttagtttttcaaccctggcccccttcctccttcagtagtcccaattttctattgttgccatctttatgttcatgtatatctaatatttagctcccacttataagtgagaacatgcagtatttggttttctgagcctgtattaattcacttaggataatggcctccagctgcatccatgttgctgcaaaagacaggatttcactcttttttataagtgcatagtattttgtggtgtatatacttgtacagttttgaaagttcctctcattgatatctagtgttattccattgtggtcagaaaagatacttaatatgatttcaattattttaaatttgttgagatttgttttgtggccttacacatggtctgtcctggagaatgttccatgtgctgatgaagagaatgtgtattccatagctattttatgaagtattctgtaattgtctgttaggtccatttggtccaagtacagtttcaatccaatgttgatcttttgtctagatgatctgttcaatgcccatagtaggatgttaaagtcaccaacatttactgtgttggaatctttctccccctttaaatctaataatatttgctttatatgtctgggtgctttagtgttgagtgcatgtatatttataattgttacatcttcttggtgaattgatcactttattatttcataatgaccttctttgtctttctatggttttggaactaaactctgttttatctgatgtaaatatagctattcctgcttgcttttggtttctgtttgcatggaatatctatcccttcactttctgtctgtatgtgtctttacaggcaaagtgagttttttgtaggcagcatatagttgagtcatttcctttattcattcaggcagtctgtatcattcaagtgactaattggtttacattcaaggttattataataggggatgacttactgtagtcattttgttaattgtattatgtttgttttgtatattctttgtttcttcttgtttttcatttcagtctgatggtcttctgtagtataaaaggtttgatttttttttctctctctcctttgcctatctgctctattgatgagttttatgcttttccatgttttcataatggtgattatcacctttttgcttccagatgcagggatcccttgaatatttcttatagggctagtctagcggttttgcattccccagtttttgcttgtctgggaaagacttcctccctcatttctgaagaatagatttactgagtcaaatattcttggctggcaatatttcttctttcagtactttgaatacctcattctactctctcctggtctggatagtttcagctgtcagtctaatgagaattcctttatatgtgacttgatgcttttctcttgctctttttagaattatttgtctttgacttttgacaatttgataaaatatgccttggtgaggaccttttgggattgaatctatttgggaacctttgagcttcttagatctatatgtccacccctctccccagatttgggaagttttaaactattgtttcattaaatagtgtttctatggctttccaactctttccctcaggaacatctacaatatgaaaatttgtttgcttaatagtgtcctttattgtaggctttctttattctttttcattctcatttctttttttctcctctgggtaattttcaaatgatacatcaagctcagagattcttctgctgaaacaagtctcttgttgaagctctgtactatattgttttattttggtacttgaattattcagctgcaagggtgtccatttgggtttttttgtttgtttgttttttttttgttttttttttttttttgagacagagtcttgctttgtagcccaggctggagtgcagtagtgtgatcttgactcactgcaacctccccctcccgggttcaagcattctcctgtctcagccttccaagtagctgggactacaggcacatgccaccacacctggctaatttctgtgttttttagtagagacagggtttcagtatattggtcaggctggtctccaactcctgacctcaggtgatccagccgcctcggcctcccaaagtgctaggattacaggcatgagccaccacatccggctggttcttttttactgtatctatgtttttgttgaatttatcattgacataatgaattgttttcctaattttgttgaattgtctatttttttgtatctcatggagtttccttaaggtaattattttgaattccttttccagtaattcatttatttccttttcgttcaggtcttttactagagttattatgttcctttggtggtgtcatatttccttgctttttcatttcttgtgcccctgtgctaatgtctatgcatctggtggaataatcacctcttctaaactttctagagtggcttttctagagaaagattttcacctgcagttgggtcttagtgcactagttgagaagggtgtggtgactttgttcctgggtaggtgcagtggtatagtctctgtgcagcttctttggctgcattcagcgtcagcaaaaactgtgggcatctcagtggcttaggggtgtggaaatttgttgtcgcaacagcagaggtgtatgttgttaatgtccttggtccacaaatgcttttggtgttctccaattcttgttttccctacaatgaggagacttcactgaggggatccctcttggtgtcaggtctgacacggcctacaatcaactgccatggtgctggattccaggtgcaaatgtttacattggcagagtcctaggatcagagtctcacaaacctatttgccctctctgtgaacctttcactctctgtggcagagttggacataggttgcccacaccatcagactccaaccccttagcagcttgagtccaggaagttaggctgtagctgtgactccactcttgctaggcagggaacagccctggactgactctaaggaagaaggtatgttctggaggtttgagcctagggcacagggtatggctataatttgggagcttgagccaacagggctcagtggcagcttgggtgccttgggatgaggcaccatgtagtggcaacactagactctaagatggtaggattcagcagtatctcagactctgtgaggccaagtgcagcagccaagtaccccagtatggctgttgtttgggtcctggggggcaagaagcagcaccatgtgactccattccttagggatggcactatctcagcagcttagactctagggagctagtccagctccagggaagcagggtactacaattgtttggcctgtagggtcgggtatctctcctcagacactggtttgtttccctgggatgaagggtactatgttagctcagccatggaacgtgcagttgctcagctcagccaaaacattgattctccaagggttgatgtgccactctactcaggccttgggggcctgactgttctgagcagcccaggcaccatttccctgccacacagggctctgacaaagtactttttccttgagagggcagtgcacagtttcaactcaggaccccagtggcagggcatagccaagtctgaaagaggtagatggagctgttctgccaaagcaccgtatccccaggaaagggcacacagctccatctctagcccaagggtacagggggaggggtaggtgaaacagttctatctgctgcttggctccacagagaaaggtgtaacagttgcttggcctggggatgttaggccactctgttggggtggttccccagtagtttagcataagggatgaaggggtgctgtggctactcacctctggagcaagatgtgagtagttccaagatggcattgcgcagtagccatgtaggccacggggcaggcacagctggctccttctctgaggggaacacagttgtatggcctctaggtagctaccccagctgggcttagggcctgtgaggactgcaggggaccccaataggggtccaagctgttgctgggggctgctgggatcctcttgcctaccttttcaccatagagagaagttcctcctggttcctggctgatctcagctgggggatgaggtggcagggtcctgttgtttccttccattctctatgtgggtctcctgagtttctgtgctcaccagggtttctgttactcctctgatgtactctggtgctgtcctttattttcattaaaatatgtttttttatttattgttttggctgtctttgtggaagggatgagtgctagtattttctagttgaatatcttgctgtcatttctcctttgagtgggttctgtcatcctgcctgttccttcattaatgtgataaataaaacttgtactcatgccaactatgtatctgcatgaaaattatatttttatcatttctataattatactttcacaaaaggatataacaaagttccacggaagtgttggttgggctaaagaaacaggaattcagtttagcttccagtatcaactcccagaatgtctgtatctattcttattttgttataagattaactacttgattttcacaataatctcaagattaataaatacattaataaataatgaccaattcaccaccatgatcaatcaataatcatacccaaccaataaagaatcatcagaataatctttactaatttcttcactatggaaaaaacta

SEQ ID NO: 90 - DNA, 805573 bp, Homo sapiens
gtttcctgataagcactttcaacaaaaaataacggcttattttcttcatctgattcagcaaatgctgtctcaaaccaataaaccaacattatagagatgggttaaggattaaataataaataacacatttataaataaatactggaagaactatagatgaatatgtatataaaaccatatatcctttctggagaagggttttctaatatggcaactaagaaaaatatggaaatatttgtctattatacaattgtatactattaaagtaaaaatatatgtgtggctaaaaaggccatgaataatgataagagacaaatggtcaccctggatcaatataaatcatggccagggaaacagagtcacataatataatatcgtactatggcgaccagattgcctgtatgaaaggggtaagggcccagaaaagaaagaatctgaagaccagcacctgtcccaagaataatctactgcaaactccacagtaattgtaaagagtgaacatttatttcagattctggcaatatcttgagtatcattcttaattttaatattgatgcaagtttttatgtttcctctttattagggtatatatttcaagaaattgaaaaaagacacttttggcatctggctataactcattttttaaaaaacagaaaggcatcctttttttttatttatttaattgagatagggtcccattctgtcacccaggctggagtgcaatcacagcttactgcagccttgatctcctgagctcaagctattctcctgcctcagcctccagagtagctgggactacagggacacacagccatgccaggctaattttttttttttttttttttttttttttagagatgaggttttgctgtgtttcgcaagctggtctcaaactcctgggctcaggtgaccctcctgctttggcttcccaaagtgctgggattacaggcatgagccactgtgcctggcctattatttgtttttaccaaagttatatacataagcacatataatcaaaaacatcattactactattattttgaacaaatgattatctgctagatcaagtaaggctaagaaaaatcaaagattttattttgctttaatttactcattctctggtacatttcctttctttgtgtagatccaggtttctgaccttgattattctccttgtcactaaagaacttcttttaatttttctggctgggcacggtggctcacgcctgtaatcccagcactttgggaggccaaggtgggaggatcacctgaggtcaggagttcaagaccaacctgaccaacatggagaaacctcatctctactaaaaatacaaaattagccgggcgtggtggcgcatgcctgtaatcccagctactcgggaggctgaggcaggagattgcttgaacctggaggcggagtttgcagtgagccgagatcacgccactgcactccagcctgggcaataagagtgaaactctgtctcaaaaaaaaaaaaaaaacaacaactttctttgaaggcaggcctaccagcaacagtttccctcatttttttgtttgtatgagaaagcctttatttctccctcatttttgaaggataattttacagggcatagaattttaagtcggtaggattttttcctctcaccgtgtttagtatttgattccactctcttcttatttacatggtttccatggagaagtcagctgtaattctaaactttgctcctctataggtaaggtgtttctttcctctgttttctttcaggattttttctttatctttctgaagcttgaaaatgatatgcctaggtgtcttttttttttttcttttggcatttttccagctttatgttctctgagcttcctgggtctgcagtttggtgtctgacaagtgtttgggaaaattctcagtcattattgcttcaaatatttcttctgttattttctctcttatcctgatatgttacacattttgtagttatcccacagttcttagatattctattctgggtttttttgaagcttttttctttttgcttttcagtcttggaagtttctgttgacatatcttcaagttccaagattctttcttcagccatgtccagtctcctgatgagcccactgaaggcatttttcatttcagttacagtgtttttgagctctggcattttttaaattctttcttagaatttccatctctgtgcctatatgatccatctgttattttaatcaaaattatacatgcacagaggtacctggtgacaccaattcttttgccataatctctttttcacattgtgtaacttggtcctgaattagagatttctctctctttcacaagcataatgtcagattctatagttttcaagaaacttcagaatgtctttgtgagaacagtgagagagtttgttctcattctagccaagaaaaaaaaagatactaaatatcaacactaaaactgaaaacacagcaccaagcaatttagagaatttgattaattttgtacattaaactatgctgctctattagttcttccttaccactcttttcatgaattatattgcaatcctatattctattattggccatctggatgaaattataaattataataaaaagaatccttgatgaagggtcatgcacatttttatttctgtatctactttaaatgtgttaatactatagagttgcagaaatttgaagtaattttaaattgctcttatggacaaaaccctaagcctccactactttgcaatgatggaaaaggccacagagcactttgaaaaatcatacttttatccccattatctcagccaaatgtgaactgtggcaaacatcatgtacctgcaagcttctctccacctataaggcccctgtcttcttcacatgctaccctttctacctgggtgtgagcatcaatggtctggagtcataacttctgggagcaggtctgcttttgatcaactataccactcacaagattttatgtgcttggttctcttcaactatgcaaatagtagatcaactaacaactgttccagccataaagatgaaatcctcttcattcttacattctcttataattgacaaagtattgaaatacttagtgatgctctactgctactacaatagctagatagaccttttgttccatcattagttgattcccctccattctgggcctgttttcattaagttttccttatataatatgaggaaactgtgaagcatgatttctcaatctcattatcagcactcttgacatctggggctgtaaaattctttgttatgtagggctgccctgtgcatcatagcatctctgatctctgcccactagatgccagtaccactcccccaacttctagtgtgacaaccaaaaatgtctccagacattgccaaatgtccccagggagtgaggggtaaaattaccctcaaaccccaaataaaaaccactgttgtaaagaaaacttaaatgttataatgtatataaaggggactcacaaactatgcagtttaggaattattatatttttaatgttttttgtcaatgtgttgtagaagaatatgagatgaaatataggcaaagagtgaaaggtggtccttagagtgtattccagtttactgtctgtatggaagttgccttatgagaaaaggcagacaatctctaaggatgccttaaaagaggtttctgtagctagtcatgtaacagttaagttggccatggtacccacatcatgattaccttacagcttattccttgggcaggggactagcccctttgctgcttgctataagaggtgctgagcctttaaccctaggttccccgcatgtggcacaacccactgtgtgagtagctgcccattaccaccccatgggactttgggacaggagaaccagaattaccatgctgatgttcccactgtgtgctgtgctgtcttgcttgagtctctttgtctattttcacacctccaaagtggcagcaagccaacctggttactggcttagtcatctccttggccttcttgttactcttcaccattctctatgagggaggagtttcccctgatactgggttaagttacttcacttccctttgtctttgtttccacattttaaaatggggataataatgatagtacttaaatcttagtgttgttgtgaggatcattcaagctaatgtaatagcctgataggtaattatgtccaaactaatgccatgttgcttagttctattttctcctatatgtccctgtgttagtctgttcccacattactgtaaagaaatacctgagacagggcaacttataaagaaaagaggtttaattggctcatgggtttgcagactgtacaggaagcatagcagcttctggttctggggaggcctcaggaagcttccaatcatagtggaaggcaaaagggagtaggagtctcacatggcaggagcaggagcaagagagagtaagatgggaggttttacacttaaatgatctgatctcatgagaactcactcactcactattgtgaggacagtactaagagggatggtgctacaccattcgtgagaaatccacctccacaatcctatcacttcccaccagtcccacctccaacattggggattacaatttgatatgagatttgggtggggacaaatatccaaactatatcagttcctaccttcttagattgcctactaaactccaaatcctacctttctttcacagtgaaatttacttttctttgtcatagactacatttccatttcacagtgcacatcatctcaccatctttcttgctttctctctccctcagtctcctctactcattaacctccatcctcctttgccggacagattcctccctttgtctttggtgcagttgtttgcagaccaaatttgttgtaacacgcccctagtatttcagtttttacttcaaggtgattaaaagattttcatctagtcaagtccctcctaccaatgaaattcttgttaataaaagtttctttatcacctcacataattcattgttcaatgaatatttttgttcctatagtgggttaatattttgatattcaactatgtgatttttcttaattcctcttacttatcttttctttccccaccattcaaggagtgttagggttttagaaatacagatacaaagatgatacagagagaacaattaaatctttaacctgaagctcttgagaataattctgtaaagtccatagcagagaaaaaggtcttaaaagtcattgctttccattattagagccagagacttagagaaacatgttatttaaatccccaaagtcagactttaaatatccaaagccagtcccccagagggccaagtacataatatttatactaaaaccacggaaagaaatatgtgatgtcctaagaaccatgtcctgctcagaagaagatcaaagcttgaccagcaggcaggaaggtggggattaatgaaggatgtgctaagggttccaccgctagtgggacccagtgttatcacttcctcccccaagggcaaccctttgcagagaggcataataagctcagatgcatgcatgtgtggcattccgtagcaaaaagaactattacctgcctttccagacaacccaagcaactgtaaccctcacagaggacccctgaatccacctgggcagtagaacagtgatgatgagggctgggactgttaacatcagttctttggtatgtggtattggaaggaggtggagcaatgagtaattttttgtttgtatgctccaagactgtttggcttgaaaaaaagggtatgatctagtcatgcaatattttttaaacaataaaataaaaatgtgaaaagaaaaaaaaagtggatgtgagaagggaaaaaaaatctcgtaagcttagcagtaagtttcaaaagaaactctctaaaatttttatttaaaaattaatattggttagatgcagtggctcacacctgtaattccaacactttgggaggctgaggtaagaggattgcttgagaccaggagtttgggaccagcctgggcaacatagcaagacccttgtcactacaaaaaattaaaaattagataagcatgggagtgcacatctgtagtcccagctactcaggaggctgactaggatgacttgagcccaggaggttgaggttgcagtgagccatgattgaaccactgcactccagactgggtgacagagcgagaacctgtctctaaaaaataaataaaaatgaatctcattttgaataatcagactttcacttctctcttttcatctcttaactctgcacctctgattaaagtgatgaaattgagtaaaatgagaagaaaaagggagcttcttaaaataagccacattgtggaataaactcaagaattaagatctgatcttgctaggttttgagtcttaattttcaaggaccactttcagttgtggttgtgggagttgatccccttttctcaactaatgcccgttaacctggaaatttctctattccttcattctcttctgtccccaccccgaaaccacaccccacatctctttctattccccataccatgcacattcacatgcccagaacttcttatcttcttgtctttaccctaatttctttttctttctttctttttttttcgagaaagagtctcactctgtagcccaggctggagtatgcagtggctgatctcagctcactgcaacctccacctcctaggttcaagcgattctcccacctcagcctccagagtagctgggactacaggcgtgtgctaccacgcccggctactttttgtatttttagtagaaactgagtttcaccatgttggccaagctggtctcaaactcctgacctcaagtgatctgctcacctcgggctccaaaagtgctggcattacaggtatgagccaccgcgcccagcctttcccctaatttcttattatcccctacctctaggcttccccattcccctttctcaagatcttcttttatcctcaagaccacatgagacatcataacttcattgtgagaggcattaatctactggatggagcacatgtggggagtatctggggtctataccaatttccatagtaacctttttcagggaaatcacttcatccttaaaaaatgggataaaggaaagaaataaggctaaccaccctgggctacatccaagaacagtgcagagatatggagggttccaggctgtgtgaaagacggttcataactgctactaattgtagctaggaaagagaggaaaggagaacacgaattagagcctgagaatggagagagagctgaaggagttgatggcatgatttgtcaagctaaaggaagaaagaaaatgagtcaagaaacagaaggtcacagaagaaattcagcaattaatttgtttaatactgtgccattccacccttcttctcccagttcagtgcacaatccctgagctcaggatatgcccttgaagtttcaaagtcaggaaggataagctggggtttctgaagaggagagttttgggggcgggggcctactagatataaagaaatatgtgtgcctactttagtacattttccattacatgatttgagtgagggtaaaaagcataaaattaagcatttcatttttaaaatgtgtattcaatattccaagagttattcttatcaacttaaatccagaataatttttcatgtgatgacaagcaatgggacatggtgatgtctatgattttgtgtccgagcaagtattgtacacttgattaatcttttctggataaaacattagcaattcttgggaaaccaaagcttgaagcagagcagaatgaggcgtgacactgagtaagtggtgaacttggtgtcattgagctcctttttagggattaaaccatctcagaatgcatttgactcacttcaggaagtaatgctgcaaagcaaatgacctacttcatacttaatccccaatgctgcaactttgtgcagcattttgaagaagcccagaggacctgatcctagaccacccatgaggaagtagtaaacccccaacacccacaacactgcccccacatgcagaagtgagaacagattcaaaattgtgtggaagtgcttgctgcgagggcttttggcctctgcctgcccatgttaagcaacttgggcacacacctccagtgtcttggcaagaatctccaactcccacaagaatgggaagaaagccaaagaaggccaaagaaggccaaaactttctccaaacaagctcagtagcaaaactctgtgggagagagagaagtaaggcaattgccctaggcatattgggcagatgagtcagcacccagcaagagaggagcctgtaattctggagaagttagggctggtaccaccatggaattaggtggagaggaagagagaatgtgtactcatcaagaaaaatggatagtccagcatgcagacatggaaatgccctcttcaccgtccttcctttcctaagaaattctgggttctaggccaggtgcagtggctcacacctgcaatctcagcactctgaggccaaggcatgtgggacacttgaggtcaggagttcaagaccaggctgggcaacatggcaagaccccatctctacaaaaaaattaaaaaattagccaggcgaggtagtgcacacctgtagtcccagctgctaggaagactgaggtgggaagatgacttgagcccaggagtttgaggctgcagtgagctatgatcgtgctattgcactccagcctgggcagcagagtgataccgtctctaaaataaaataaaataaaataaaataaaataaaataaaataaattctgggttctctgtccacacctgtagttaaactcactgagaaggaaaataccaagcattgcaccaaagtctaagaaatcaccactaaagaacttacccctgtaatcaaaaaccatatagacccctaaaaactatggatataaaattttataaaagaaaagaaaaagaaaatgcccagcaggtggcagcactagacaactgaagtaaaacaaggctgcaaggcaacacgaaagttcatcttggagactttgcgctgtaactttccttggtgggattttatttagctatcagtgaatatctcataagaaggaatttgtatcccagcacctaccacagtgcctgacacatgctgggtatatgtgttgactgaatgcaggcaggctggcaggcaggaaggaaggaaggaaggaattttgacaactcacctaaactagaaaaatgtcatcatttgaaatggccatattctcttcttatcccatcattactattgtcattttaattagttttagtaatattaataaagcatcctactagattaattttctctactcacccttttgacaacctacatccttattctctactgaattaaatttttctcatcgcttttggagacttttattaaatctcagggttaaaaaaaaaaaactcaagattagaaacaccacagctagaattccagttttaaaagaaattatttgtctttgaatgttggtgtttataaggaaggcatttatgagtagactatcgttctttgattagttgtattttttttaaccaatgacttgtttgcagactgtgcttaagttttattattatttaaaaaaaatttgttttcttttattgaccatctctgaaatatgctattgtgcagtggcttgcgcttttttagaatcctacttaataataatttaaggtaataaaagttagaagaaagactaaataaactaatagatgataagaaatcactctgcccatgcactgtgctatattgggtcagagtgatgactttctatcactttcgagatagaggaagaaaatcctcaccctttgcttcaccagatacagaaaatggctacattggacacccgaataagagcttccaaatctacctattagaacgaagggtagccaaactttccctgaaagctaatgttagctgagcacgatggctcatgcctgcaatcccagcactttgggaggtcgaggcaggagaatagctggaggccaggattcatgaccagcctgggcaacacagcaaaaccccctctctaaaagaaaatgtttaaaattagccaggcatggtgatgagcgcctgtagtcttagctagctactcgggaggctgcagtgagaggctcacgtgagcataggagttcaaggttgtggtgagctatgattccatcactgcactccagcctgggcagcagccagatcctgtctcaaaaaaaaaaaaaatgctaatggtaaaatttttgctagtaagaataatggcagttgatgacactcagttggagcatgtagttgagttttttgagggcgggtatgttgttttatgtactttcatatatccctagcatctcaccttgtgtctggtatattttaaaacctcaatcaatatttactgaatgtgtggagactatcaagacatatgtcactgaacagtggtacttgaatcagagccacgttctcagcagaagaaaagaatagaatggcagatcatgggagtcacaattcagcagacttataagaatgggcccagagccaaaataattagcatcatctggaattggtgacaccctagattatctctttcatcttaggaactcctatcctcaccctgttcagctttgttacacatagccatcttgctgctgcttttacacctttattgtgtattaaatgcaactttcctgaacttgaagagcctctgagttcttcttatcaataaggggaatgttctgagttatcatgtgtctccctaattctggaggaatagtgtatctaaaaacaagcatcttacatgttgatgttccctgcatcaagcttaattcctattctattttcattctgcatgctctccccaggcaagtgcatccccacccataatttctaaaccaggaactgcagatctttacttgtgattgccattgtttcttgaatttcaaatccatacatatagctaatttcccataagaaaactctacctgggcataccatatattaatagctaccttaaatatatcatatcaaagatcaaatccacaggctctgatttaagatggcagattaagcacatttgtttatctttttcccaaaaaccatattgaaatcatagtaaaagaataaaaagcatgtcaggcacagtggcgtgcacctgtagtcctagctactcagaaggccaaggcaggaggattgcctgagcccaggagttcaagttcagcctgagcaacatagacctcacaaaaaaaaaaaaaaaaaaaaggaaaggtaaagaaaggaaaaggtatgaacactccccccacccaacccaaccaaacaaagagaatggaagggaagctaatggaggaatagaggttacagcaaagttctagaagtcaggagatggatgaagagggatgactgatgatgatcagagctgatgaggaagctgcagcctagtacccctgagggatgagactacagccaaaaagggagccgatctgtctagaattaactcagaaatttgtctcaacttggagactacagttctacagaaggcaagagtaagaaacagacaaccagcaaaagcacattagcatcttcagagaaattaagaatgacattgcatccataaaacaagagcaagataaaagacatgaatgccaaacgtcatgcttctccacaacctgtgtctgttcctgcgcctcctgtctcagtgaatgaatgcttccatcatgcacccagtttcccaagccagagagttgaaagtgatccctttattcttcccttctctttatgcctcattcaataaactaagggttgattctacctcctaaatatcctttgtattttcccctcacctctcttccccacagccactgcgtttaatagacctttcttacgtctttcctaaattctagcaataacatttatccctgctctatctctagtttgaagccttcccaaacctttctccaggatcataatccccagtttcagtcaacccagcatctggcatactgcccttcaaccagtgagtgtctaattgtcatttggattgagtaatacctgaccatctgtccagcctgcaatttttactgctccatactttcttctttaaatcccagaaatatggacttacttttagttctttctcaaaacatgtctcctttttaaaacatgtgctgttctcccagcccgaaacccgcattctcgttgttggcatagaaactccttcaaggctcagctgaaatgttacttcccctgaggaagttccctaatttcccctggactgacatgggtattcatactttatatgccctgggaatatctcatgtgccttctctacagcacttttgtgttgaattgtaagttcctgtttccccagacccgactgtagcctctttgagggcaggaaccaatcctctgagcttggtatcccttgcacatatgcggcataaaggagtggttataatcacagaattctattttttaagatagaaggaagctcaagaaattatctgtatagttcctatccttgagccaatgaaatattatcattcttatttattaattgaggcaactgaaacatgcagatgaagcaatttatttaaggttgcaaagtgaagtgcacaggcttacgtgggcaatggggacagaggcagggaggggagagagggtgatcagaactaacatcccaatttccttcttacacagtgctccttccacctcgtgaacacacctcttaccaatcaattgccatttactgaagaaatccaccttgaaaaaagaaaaggaaagataagcaacaaaaatatatacattgcccaaactgacaaggaaattactttctttaaaataatgacaggccagatgccgtggctcacgcctgtaatcctagcactttgggaggccgaggtaggcagatcagttgaggtcagtagtctgagaccagcctgaccaacatggtgaaacctcgtctctaccaaaaaatacaaaaattagccaggcgaggccgggcgcggtggctcacgcctgtaatcccagcactttgggaggccgaggcgggcggatcacgaggtctggagatcgagacaatcctgattaacatggtgaaaccccatctctactaaaaatacaaaaaattagctgggcgtggtggcgggcacctgtagtcccagctactcgggaggctgaggcaggagaatggcgtgaacctgggaggcggagcttgcagtgagccgagattgcgctgctgcactccagcctgggcgacagagcaagactccatctcaaaaaataaattaattaattaaataaaataaataaataaaaaattagccaggcatggtggtgcatacctataatcccagcctgagctcagaagttggagaccaccctgggcaacacggtgaaaccccgtctctgctaaaatacaaacacttagccaggtgtggtggtgggtacctgcagtcccagctgcgaggctgagggatgagaatcactccagcctgggtgacggtgtgagtccctgtctccaaaataattaattaaaataaaataatgaccattgttacctgatatttttaaccttagtgttgtttcaagccaggagggtaatcatcctctgagagtatagaaccatttattcatttggaactatgtcccatacataatttcctattaaaacaaactaacaagcaaatgctcccataggctgccacagtcagttcttccctgtattcattctctttctctctctctctttccttgtttttagagggagatggggtttcactatgttgcccaggcttgtctccagttcaaagcttctcgagtagctcgggctgtaggtgcatgccaccacacctggcttccttgtattggcttattgcaatttctggtgcatacaccaatggtggcaagtgagccaaatattatcagcattctggccagccaaagccattttcttccctgcctcagcacagtctcacatagcccaccattgtcttgcctattcttgacagtttgcaagatctgtgtcttctgtttcttttttatttcactcggtgccctatctataattataatagatactcaagagataacttgttgacttgataaagaaaacaagaactgcagaacactcagtgactttttacactttcttacccatttctgtcttagatattgttatttgatagctccttctcaatctacttatagcctgaatctatatcagaatttatgcagatgagttgcattgagaacacccatttttagactacctaatcctggtttttcaaccaggtagagccattcagccagccccagttttgctaggttagctcagttaataagaacagaagcaaaactgattaattggattgtgaatcctaaccctggttgaccaaaggcaatagacagatgttactttgtcctttttagaaccaccatgcaaatgatataaatttccttgattctgccctctactcttttctatttgaatattttctctctgggcagttttatccatttagcatcatcataagtaatatgctaatgactcccaaatctacagttctaaaaccaacctctcctaagagctgaagaccccaatttcttagggcctcctacacaaccccacatggatagtctgatgccaccttaaaaataagatgtctaaaataaattttagcattttactcgaatctatttctctcactgttaaagatatcactatctttccaaacataatggcctagaactccagtcataatttcaactcctctgtactgtcctccccccctacattgggatagctcaggtggctcctcaactcacaagaagttcccgtgtggccgtgaatataatgccttcctttactcataaatcatgatttttatggggtctgccgaaaacagtacctcattgccaggtccagtgactagtgcaattggtggatatttggccccagcccatcaattcctctctggaaaccttcagactggcccaggagaagatcccattcttcttgagttcctcagctagaagaacacacctcctgaaccaactatggccatgaccctcaagcttggagagagtctctaccgcagagaagaaaaaagccacattcagaaaggggatatggaggaagaatgacacctgaggccctgattcgttgtccctacctggctgtatctctgtctttcccaaagttaggttcatcatctgactttgcaaatacattttccttttttttctttataatgagccatgttgggttttcatcatttacaaagtccaaacttaaaacttttcttttttcacccatgcttccccttgccctgaccagataggaaaagatttaatcagttgccaaattctgtggcttcttcctcatagacatcctccatatgtgtcccatccactccatctagcccaggccctgggttacagtaatggcttccttaccacattcccaaactctaatcttgcattctctaaacatcctccaattgccgtcaaaaagcttctaaaaaaggtatggtggtgtgcgcctatagacccagcatctcaggaggctgatgtgggaggatcgcttgaacctgggaggatcgcttgaacccagggggcagagactgcagtaagccaagatagctccacagcactccagcctgggcaacagagcaagactctgtctccaaaaaaaaagcttctaaaagactaaatgtggctgggcacagtggctcacacctgtaatcccagcattttgggaggccaaggtggaaggaccacttgaggtcaagagtttaaaaccaacctggccaacacggtgaaatcccgtctctactaaaaatacaaaaattagtcaagcacggtggcaggtgcctgtaatcccagctacatgggacccgggaggctaaggcaggggattcgcttgaacccgggaggaggaggttgcagtgagttgaaatcgcgccactgcactctagcctgggtgacagagtgagactctgttttaaaaaaaaaaaagaaaaaaagaaaaaaaaaatactgaatgtgtcagccttctcttcagtagtcttcagtggctccctcgaacccacagaacaaaaattaaactcaaatggcctcaaacatcctatgattttggcacttgctttttttttccactttgtctctcagtatatccttcaggcaaacatgaccactcacttatcactaaatatttcctgaattttcctgtctctatgcttgcaattttctctccatctaccagaatacaaatcctacccattcttaaaatgccacttcttttttttaaacctttgtttgttgtttttgagacagagtctcattctgtcgcccaggctggagtgcagtggcacgatctcagctcactgcaaccttctcctcccaggtccagggaatcctctcacctcagcctcccgagtagctggggtcacaggcgtgcaccaccacacccagctaatttttgtatttttagtagagacagggttttgccatgttgcccaggctggtctggaactcctggcctcaagtgattaaccctcctcagcctcccaaagtgctggggttaaaggcatgagccaccatgcctggccatatgctgccttctttatgaaacataaaacctcccaaacatcagcaaactacattttctttgcttctagagcacttgatacctttactttgctttatactacagttattttaatatgtcttattttccttttaggctataaaatttcttgaggacagaaacttctatgttaaccattagtaccaaacattaataagttttcaccaaattgattagacatgtatatttggaaagagggtttgtttctcctcttatttcttcaaactttaattcagtgttggaattaatgcttccagtggaaactgtgagacatttattacgaaaatctaggtaactgcatcattttctatcctaccattctcattcatttcctctgtaagaggagtcccagttcaaaataatttctgggagaaaatcgaatgcctgattctgtcccattaagaaaaaacatcttccagcctcactccctttcttctttccttcttccttccttctttcctgtcttctttttttcttttttctttctttcttctaagagataatcagaatgcaagctatgggccagatgcggtggctcatgcctgtaatcccagcactttgggaggcctaggtgggcggatcacaaggtcaggagatcgagaccatcctggctaacgtggtgaaaccccgtctctactaaaaatacaaaaaaatcagccgggcatggtggcaggcgcctgtagtcccagctacttgggaggctgaggcaggagaatggcatgaacccgggaagcagagcttgcagtgagccgagatcgcaccacagcactccagcctgagcgacagggccagactccatctcaaaaaaaaaaaaaaaaaaaaaaaaaaaatgcaagttatggcttaggtataattgtaggtgccaaactaaagtcaacttttatttgtgactcttttgccattttgtcaagtcagcagttcatcttctctctgatctatgaagactgcacctgaactagtttgagtcatgttatttgtatgacataaaaatggggcatctgataacatctgctccctttctcttatccaaatcacgaatagcgttcctctcccttcccttagtcaccagcttttgaagatttacaatctgtgatagtaaaaagaaatggattttgaactctaagcagtccagttaaagtaaggaagccacaagagaaggaaacacagagtgaacccttaataataaggacttttctgtgtgcaggaatgagctatggaagatgggagagaagaatgaggatggatgactaagagcaatgaaagcttacaaagaaacccaagaaggcgaaatatttgcttatgaataaacaggaagggaagaaatagctttctgcctttcttgtagtagatactcaatagccatttatgtaagaatttggacagtccttaaaagataagacttgcattcttagaattgagaatcaataagaaaaactattctttgagagaaccatggttattttaaggctatgggatgacttatataaatggtttgaccagaacttatttaagctcctatccacatacaattctatataaactgagttttagagagtctttggttccaggcatttatagcctgaaactatatcaaaatttttgcagataagttgcattgaaaacagttgtttttagacaactttatcctggtttttgcaccaagtagagccattcagccagcctaatattgctaggttcacacagttactaggatctgaaacaaacctgatcaactggattccgagtcctcaacctggttggccaagggcactagacagatgttactgatacagagtcaaataatatataggcaactgatctgatatggaaccagagagttgggatatggtagtgaaaattgcatcagatttctgctcagaacaacctgagtttgaatcttggctcccttgtgtagactttgagcatatcactcaatttctctggttcagtttcctgtggctgtgaatgaaaaactccatttctctcagattcagcttcctgtgaaaaattggaatataaagttgtgaggattaaataagacaatgtataagaaggtaacttagagtctgcaaagtgttatgtaaatgtaaggtattatgaatttttggttatggacttgttaacaaagtgatgtgttaacattatgcttaagcaaagggtttccattattagatttgagagcaggagaattatgtacaatatatatagagacaggatgagccatccactaattcaatactaattcaaatgtttattggcagcatagcatactatgtgccaggagtgttttcagtgttggagatacagcagataaaacaaaaagattataatacctgtcctcagggacagcatacagataaacaatgaactagtaaaaacaaagagggctggctgggcacagtggttcatgcctgtaatcccagcactttgggacgccgaggcgggcagatcacctgaggtcgggagttcaagaccagcctgaccaacatggagaaacccagtctctactaataatacaaaaattagctggacgtggtggtgcatgcctgtaatcccagctactcaggaggctgaggcacgagaatcacttgaacccgggaggcagaggttgcagtgagctgagattgcaccattgcactccagcctgggcaacaagagcgaaattccatctcagaaaaacaaaaacacaacaaagagggctgcaaaaagtcacttaggtcaaatttgggattatatcactgtgaagttcacgtagaatgatatttttcagttgctgatgtcacaaaaaaaagtgaaacaaactatatatacacaactaatagacactaaactgatttttaaaaatctcagattatcaggagggagtcacttctaaagtcctccccacctccaatcactactcccctgcccaacccactcccacaagaattttgactggttaagaactggatcgaggctggacagaagatgggaaccccgtgctttatatctggggttaatgtccatgatatgacagaatgtgtcttggagaaaagtagcctcgggaagggaaatagagacagtcctgggtggtgggcatagaagacggtgggaaggtggcatctaagcctgaaggtgagggagccatccacatggagatctgggggaatcccatgcccaccaagaggaacaaagagcagatggccctgagctgagagcacatctagtgtgcacgggagagagcaagggggtcaaggaggccacggaggaataaagggcggggtggtggtggcaggaaaaggttaataaaaaagaagatcagaggtaactgggccagatggggtggggagagccacgaaagacactgaacgtcatgttgtaggaccttcttcttggttcagctgaaagccaggttcttgtcacaaggccatgagagattcggttcgcatacaatttgaatggcgagaaaaatggaatatattgggcaaaaaagaaaaaaaaaaggaagggggcggaaacaggaactctcagctgagcgagagtcttgttagcggctttttctgcctcacagattgaatcccaggtaccaccccggaccaggtggggccaggctcctcccacctgcaaatggcgggaacctccccaggctccaccccagtgcgcattcctcccagtgcgcagacaggtcggaggttctgcagggagcccttcccacctggctgtctctcttactctgggtgagatggggagctgtcgaaagacgttgagcagaagagtagcatgatctgaatgctctccaggataactcaggccactgtgttgagaacagactgcaaggagcaagcacagagcagaaagcccagtgaaaagccatagaaataatccagggtagaggtggggacctggaccaggatgggagtggtgttcatgggaagtggttggatttggtatgttgtttgcaggtaaaaccaacaggatttgctgacaaattggatgtgaggtgtaagagagagggaggtatatagatagattccaagcttttcagcctgaacagctggaagggtcaattggcattgactgaaacaaaggtgagcaggaattggcttgagtgggattagcttgagaagtcaaggatcatttttccacttccttctattgtggtaagtgagggagtcaggatttaatgagcaaagaaggagaaagaatttagccaattggaatgaaaatggcattccaagagtaggtgagaacatagatgcaaaatatgagggtgaatgatgggcccacctagtgagtttgctggaacggcttagagcagatggttgagttgaggagtagggaggagaaggcaggaagttgagggagcacaagatgaagacttgtatcttgttgttttaagattccatcactgaggccacaggagcaggcaggaggtaaaaaacaggtggtagacgatatcctgttggttgtagtcttgagatgtgtgagtgaagagcaaggtaagaatttcaacaaagacaacaaaggtaaaaagaaaatatcagtctatggcatatagatggggagaaatcttaagaaaaaaaggctggatttagaatatatcatcctcaggcagggcgtggagactcatgcctgtaatcccagcactttgggaggccaaggcaggtggatcacctgaggtcaggagctcgagtccagcctgaccaacatggtgaaaccccatctctactaaaaatacaaaaagtagccagacatggtggcgggtgcctgtattctcagctactcaggaggcaggagactcactagaacccaggaggcggaggttgcagtgagctgagatcatgccattgcactccagcctggggaacagggtgagaatccgtctaaaaaagaaaagaaaaagaaaaagaatatatcattctcatggcaggaagagtaaaatatatttttaggtggccttccatttgacttactctccgtccaatctattaacttctgtgagttccacctccaaatatttcttggatctgcccacttctattggtttccactgctaataatctgttctaggttactaagatctcttctctttactattgcaactgcttcctaaatgtccctccacttctgctcttgtcttcttctaatttatttcccatataggtataagaaagaatatattaaaatgtctatcaaacattttcagatatctgggatattctttttaaagttcaatgattccccatttcacttagaataaattataatgataacagcacacttgtggcacatactgtgtgtcaggcactatagtaacagcattacacagattgatgtaagtaatatttaattctatgaagcaggtgctgttatcataatttatatctatcaaatgaggaaactgaggcactgggagctgattcattcaggaggtctaccttaacttggatttcccagaaaacagaaccccactaaatacatatgtgctgctcccctcttggagattgcaatctcagaaaagaggagtgagtcaggcaaagaaggaccaccgtttacaagaaaaggccacagcatggcatgaagcacaactgattgcttggtcttgcaacaccattgctatcctggtcactccaactaggtagaggagaagaatttattcatcggcatctctcactctttggtcagaggtttaccccgtggggcattagctcccttgcacttgtgcccaaaggcagatctttgccccaacaggaatgcacctaggcaaaagatgacaagtgtgacaggacacaaggcaagggattaccaggttggtccacacaaagcccactggaacccaggtagagctgcctgtcacactgaccactggagcagagcaagtagctaaagaccctcaggactcatgaggccagagaacctgaagtagtgcacaacaagtggctgacgcatataggcagtgaagaatcaagctggggtaaaaactctggcagccgggcctcaaagcccacacatttaaaatttctctgatatgctgccttgcagaataaggcctgaaccatttaccatgccctacaatgtcctgcatgatcgggcccctaccatctgtccaactccatcttgaaccttctttttctcactcacaaagcttcaggaacttgttcgttcagttcctaaactccgctccatcctttcctgccacaggaccttaatgcatgagtcctctgtgtggatgctttttcttcctcttttgcatggcaaacactttcttatcttttagtcacagtttaagtgttgccttctcagagagaacttcctgaccactctgtaaaagaggacttccccacttgtaattcttctcttccactccatgtgtgtttctttcacaatactgatcacagcttgaagtaattttattaatttctttgataacttcttttttgtttctgtctccaagagaatggaagcctatggaggcaaggacaatgtctatcttcctcaccattatagcctcagcatggagctcagtgcctgacccaaggagatgctcaatgaatagttgtaagatgaatgaatgaagtgttcttatatgagaaatagatttttttttttttgagacggagtctcgctctgttgcccaggctggagtgcaatggtgcaatctcggctcactgcaacctccaccttcctggttcaaacaattctcctgcctcagcctcctgagtagctggaactacaggcactggccatcacgtccggccaagttttgtatttttagtagggacggggtttcaccatgttggccaggctggtcttaaactcctgacctcaggtgatccacccgcctcggtctcccaaagtgctgggattacaggggtgaaccaccgcgcaaattttaaagtggtattgtccatatcagtgtttgaggtagaaacactgtggagttgctgaatggacaaatgaatgatgctaacgggtgaaggaagataacagactggaaagaaattagatgaatggcctggctctctcaagttttcttccagctctacaagtccttgaactatggaggatatctttaaggaagtgcaaaggaaacaggaaggaagcaaaagtaggaattccttaggaagttcagaagaggaaagctggagaatctggcccattgtatgacaaacaggaagttatttaaagcagggttttgaaactgtgaacctctaaatggcttacaaaaatccaagagcactcataaaattgtatacaaaacatgtctccatatctgcatgtgcaattttctaggcaatagtttctatcgtatttgaaaaggaacttataacttttacatagttaggaaacactgattgcagaaacagatgagtctacagataatctagacttacttcctcagttttcaaatgaagacatcaaggcccaaagatgttatggaacctgctaaattgcaaacacaatcaattaggtgacaagagggcacaagactcaggtctctcaattccccttctagtgttctttgctgtgccacaataccttcctgaaattcagttataaaatactgtgtgaagaaaaaaagaaatgtttaatatcttggaaaatagaagagaaaatctaaactgataacataggtaaatgcaatagaatctcaaggctaaaggagcctcaaaaggcccactgaacagttccctgacttcaggcaaaaatcctgtaaacatcctggaatgattatttttcaagatggttaaggaatatgaaagaaagagtcaaaataattattcagcacttaacttagaaacaaaatactagattatctttattcataaacataagcatgaatatagttgtctcttggtatctgtgggggattggttccagggcacccactgataccaaaatccacacatgctcaagtcccttaaataaaataaaatggcatagtacctgcatacaacctccacacatcctcttgtttactttaaatcatctctagattctttataatgcctaatacaaagtctacacatcacttcatttgcatggattcaatgtagtacttggcatacagcaaattcaagtttgctttttgaaactttgtggaatatatttttccaaatattttcaatttcttggttggctgaatccacagaagcagaacccactcatatggagggccgactgtatatatcaaagttgctcacaagaaagaatttaaaaataaaggcataaactgacaacctatcaaaatccaatgctcaattatgatgcaaaatgaaaacagaaacatggtatgttttttaataactgccgagataacaaagtatggtgaacatttgattatctctcccaatgtgagtttaaggacaaattaagtaaattaattgcacaatctatagtccttaacttaggcaattagtcaacttttgttcagagaacatcagactgttaggatacctgagttaaatttcttgcaaccaccactaatttctgggcttggacaagtcactttctctagttctcagtttcctccatcttcacagtggaaaaaggttaatcttggacaagggttttcaaacttgttttgtcttttctgttttttttaaattcgattttttgttgttgttgttaccacccacacagtaagacatatatttcctgttatctgcatccataaacatatatgcccataactgaaataaaagtttcgcaagacagtattgatgctcagtatattcagtgcactctcatattttctattctatgagattatgtcctgttttttaaaaaatgtaggttattactcatcacattgatttaataacctatgcatgggtcacaatctacaggttaaaaaacatgaatatcacttgtagttttcatattctaccaataaactctctgcaagaaccacaagtcaatagtacaatttacctgaatttctattttctcccttcctatgccagaggtgataatgggcggtgacaaagaattacaagtagagaaagggtaaataagtgctttgagcatccatcaaaggaaattctgccagtaagtaatttaacattaaccagagagaatgacaggacatccacaactggaaacacaggacatccagagttggaaagttttcactgactttttttttttaacctgcctatgaactgttcgagttttgagagtttcccaagaaaatgtttgagagaaggtggggatggaaagaaggagagggaagggggagaaaaggaaaggaggaaaaacaggtgaatgttcaagtgttggtgggtagtgttgaccccctacactagcgcaagcctcagtccatgcaaaaaccccctctacacatgtgagacaggaccttctgggccgtgtcagcaccctgcactgccagaacacttcctataaatcaaaacctgactgttatatgtctactaaagattcttcagtgccttctcagcctctatagggtaaagtgcaaactcttcagcacggcacaccaaccattcgtgatctggtggcatttttcccttttccccaaaaccatccacaaccacaatggtacacacactgtcactagttgcatagagtccttaaagttctccaaacaccccttcccatgctgctttgattttgtttccactcttctctcaacagcttaatagaagcatattctttacttcctagcgatgtacttgtacttcctgttaagacagcacatctaaaatgacttcagttcccaaaagctctggaatcatgttttgttttttctgcttattttggggtttcattgggctctcctctattcattttcttttcttttcttttcttttttttttagacggagtctcgctctgtctcccaggctggagtgcagtggtgcgatctcggctcactgcaacctctgcctcactgcaacctctgcctcccaggttcaagaataccctccgctctgcctccctcttctagtccttcaattcgcagcacatgtatcccttttctttcattcccacctggtccatggtcttccaacgctgtgctcacccaaatcacagatgttgatgccaagtattgcaacacatcgcatctgctcatcttccccacttgaccctgagttggacacaggatggtgtccatcctgttcaaggtgagccgtgtccaacacactgtaggaatgccatggaatcccataagtatttgttagctgagtattgaaggactctcctatattctacctgtcctagctgctgtcctagctacctatgcctggaagctctgaacctcagctatgacggttggcagtcaagtgtgatcagattaagcagataatctctagtcttctgacaaaactttagcaaaaacttcacataaaaagtaaagtatgattctttacccattaaaaaaaaatgataatgattaagcggaatgggaacattggcagccaatcaagagaatgttatcttcctaaatggcccttccaaaacaacttgaaattaaaagtgaaaaaaaaaaaaactcagaaaacagaaaaccacagtgaagggtgaacagattttaagaaatttcatctttggactatatcccttttattagtggaaaacagaggtaaatgtggctaattgtaaaaatcatctgtgtgaaggaaggcaaagcacctctaaaactcaaagatacattcctaccttgattagtaaaagagtacaatttcactcaaacaataaatcactggtgtgaggagcaagtcacatgggctcatatagttcatttttttaatattagaaataaaacaagaaacggttaattaaatctaacaagggataatgataagaggacgaaagataatgaatgttatcccaaagaaaggaaaaaatgaaatattgcattttagaaaatgaacacaggctgggtgcggtggttcacacctgtaatcccaacattttgggaggctgaggcaggtggatcacctgaggtccgcagtttgagaccatcttggccaacatggtgaaaccccgtctctatcaaaaaaatacaaaaattacccaggcgtggtgtgcacacctgtaggcccagctgctcaggaggctgaggtgggagaatcacttgagaagactagagattatctacttgaacccgggaagcagaggtttcagtgagccgagatggcactactgcattccagcctgggagacaaagtgagactccatcaaaaaaaagaaatgaacagaggtgagcgcaatggaaccccaaaataaggagaaaaaacaaaacatgattccagagcctttgggaattgaagtcattttagatctgctgtcttaacaggaaatacaagtggacagctaggaagtaaagaatatgcttctattaaactgttgataaaaagcagatgacagaatataaagaactagggacatggtttaaatctccttgtctctatgacatacaggatatctcaattagataatgatttcttttcatttcctgaagaacaaaggggctgaataaagtaaatgtatttgttggttatcggaaagaataaagaagcctgcttccaaatgcatttcccagtgaatccgattccggtccttggtaaactctttgaagaaaatgtctatgagcacatgaagaaatgcaaccagtaaaataacatgaattcttgagagcaattcaagataatgatgggattacattttcttcattgccgggattttgtcctaaaaattattgatggttatatattggtggagaaactgtaagtgatttttacaagttttatgcttatgtttgtatcatcaaaagtttctacaatgaacatgtattactattggaataaaaaaaatccccttcctctcctcttctaccaaaaagaaaaattctgataggacaacatctaaaactttggtttatttgatcttttgtggcagaaatttgaaaaatgtgatcctgtcattcaaatgactaccaagatgatctctgagaaattaggctattcggaagagcatcaaatccaggctcttaaaagtggaaatcggaggacatagttccagggatagcaggggctttcataaccccttccgcctgggcagaggtgaactttgtggtagtgttgctattatttgacagtaagtaagcaagcatggttaggagatttttattttagtgacttagtcatcaccaagttcttgatcaaaaaaacagaaactaaatcagctggctcagagtttttgaaagcaagtttatttttaaggacaccagaaccatgaaaacatgattcagtccagcctgtgggagctgcagatgggaactggtgagctgttgggttggggtccacgcttcataagtcctggcagattcatggcctctttcctttgctcttttcttaatatctgccccattctcatctcagcagaccagatcccttcacttattcaaaatttctgctctcttgtgattttgccctgcacgtggcttttactaggccataaaactgcccccaggcatgatgctacatgacagataggcttctggcagctagcacaaactttcagagagccagttccacattgaaaagaaaagatgttgattgtctcagcgtgggtgaggtgtacatccctgtgtagatctgccatggcagagagactaggatacattttatcaatgaccactttggctcagcccttcaacaaaggtttactggggctaagttccagagaaggggactttgtgccaagtatccaaaatatatttattacctttgaataagcatctttggatgaatctgcactcctcctccctgtgcacagtctcattcctacagcagcctgccccttcctggctgaaacagaaagcagctaactcatactaaagtacttatgaacaaccaagtgactttagagcaaataattcatcttctcagggattgactacatttaattttctctaaaaagacagaattttgattgttatttagtactaccttctagtatagaaaatgttttctactataactttgtaaccgccaaaaccaaaggttgaagatcacctctccagggctatttgcatttttaaagcgaattctaaataataatgatagttaacattaattcagtgtttattatatgtcagacactcttctaagaacttaacacataataatttctttaattcttacaacaacccaagcaacagagtgtgttaattaggataatataaactgtggtaacaaataaatactgaaaatatataccttaaacaaaatcaaagtttacttcttgcttacatcacaggccaggatgggtgttcctccatctgggtccgtgggtggctttcctccatttggagattcaggaatcgaagttttttttgtttttcctgtgactctgccatctcctaaacctcactttcacctgatgtcagccagggaaggaaaacgaaagtgtggagaagttacccacatcttaaagagcctggcctagaagtaacacacttcaagtccactctgttagtgagaactagtctccgggcaccagctggatgcaagggagtgagaaatgtactctctgatgggcagccagttctcagaaaaattagttttttatcaatctggatttgcacattcttttcacattttaacatctcttcaataggaatgtattgttcaatcaatggcaagtttattattcaaggtaaactcagatttggttggcagcatttttcctttttggtagtacatacacagcgtgtgctttacaatcaatggaatcttaggctagatgaaatttggtttataatacggaagagggaggagaaattttgcctcttcctcatttagctgttcttttcaccaagtatctgtatatacacccttctttcctcattctaaggacactgcaagatggagaacatgctaaattcttatccagttcatgcatacagctcaaagaccagcatctctgggtgatatgaagtcttctcatctaaagctcttttcactttggtgatacacaaacatataaaaaaaattccctgcccctctaatatgtaatgataagacagggacaagataaccacaatagaagctcctattaagaaagggaagaattgtggatacatagcagtcattggtccattgtagaaatggatactgtcttttaggttatcataaatatggtttttaaaatgttttgccaaggccaggtgcggtggctcatgcctgtaatcccagcactttgggaggccgaggtgggcagatcacgaggtcaggagttcaagaccagcctggccaacatgacaaaaccctgtctctactaaaaatacaaaaattagctgggcgtggtagcaggcacctgtaatctcagctacttgggaggctgaggcaggagaattgcttgaacccgggaggcagaggttgcagtgagccgagattgtgccactgcactccagtcctgggtctccatctttccagcacccaacaccagttttttgttgttgttgttgttgttgtttgtttgtttgtttgttttggggggtggaggggttgctacctgctacccaagtgttcagagagtaatagttactttaggtatttattatagcagtacttttttcaaggtatcaatttttttattaattagggtaatgttagaggcagtagataatagaccccaaaatttatggctcaaacttaatagatgtttatttctcattattttaaccacccaaagcatatgtcccattggtggtcatctttcctccatagtgtgattcaagtatctagtcttcttccatcttgtggctcagtcttcccctagagcaacatctgcaaatgaatctagctggtggaaggagaaagataatggagaaaatataccttcttcttaaatcttgacctgaacatgccacacctcacttctgctcatattccacagattagaaggaaggaaggaaggccacatcaggtccatgaggagacaaactccttgtctgagcagtttccagtgacaagtccattctctaaaggggaagcacaaattctggcagacagctagctgtttctgatttaaaaggataaggattgaatcttgaattacagaaatttagtggtgggggaaaattttttttaatagcattaagtagttcctcatagggtacctcagatcataacatatcagtaaccaccaactctgtctcctaagtctgtgcctgtgtactattttgaaatattagattaaatatatatgacaaaaaatagaacaaaaaacaagaataggtgacaatgttttaaaagtagccagcattggtagtagtaatcatatagtagaagtagctggcattatttttagtgatttctatataccaggcactgtattgagtacgttttaagcatgattttatttaaaccttattagcatccccatgagatgaggaaatttagaggtaaaataacctgctgggttaaataacgtctaaaaatatctcatttcagggcctggttcctaaccattgtagaggaggaaaatagtttttcttctaccttcttaggttttctaactggggccctggaagttaaaccaacaaaaggtggactaacaagagaaaaacagtttcatacatacctatgcatggtacgttcacagataaatgagactcaaggaggcagccagatgattgaggcttatgtatcatcacaggctaagcaaaggaaaaaaggatttggggctttggggtgagggaggcaagtattaggaaggtgaggggaggaaataattagagttgtgttgttaagcaggtaagagtctctcaagtgctgagtgctgtctccaagagcagccctctcccttttcaaatgaaaatttcctttacaaaaggggaaatgtatactctactttcaggcagtcacagggagacaggagcttttcctgcatcggatagttttcaattggctttaactcaaaataatctatatgacaaagaggcatattttgaggtggcatattcatataccctgcatcataccccaatcatttcttcaacttaatattcagcaatccctgggatttcttgaagaaaatacttgagaagtactgaactaggagttaacgatgatagtgtaggtgaatagttggcaacactttagtcataaacagaaattcaaatgaattacctgaaactgcacattagtccttggttaagagattataaaatgactcagaccttgcttttaaaaaaatcatatatttctggccaggtgtagtggctcatgcctgtaatcccagcactttgggaggccaaggtgggcggatcacaaggtcaggagctcgagaccagcctggccaacatagtgaaaccccgtctctactaaaaaaatacaaaaattcaccaggcatggtggcgcatgcctgcagtcccacctactcaggaggctgaggcaggagaatcacttgaacccaggaggcggaggttgcagtgagtcgagatcgtgccactgcactccagcctgggtgacagagtgagaccccatctcaaaaaaaaaaaaaaaaaatcatatatttctatataatcatgaaaattaagaaatcgaagattcttgtagagaacttatagtttgagagatgtctcccaattctataaatgtgtgaatccctaattttatcagtaatacttcctgctacctcagagaaatgctaacttgttgggagagtttttctctccttaatattattgatccttgactttcaaaccttatgctctttctaattttttttttttttttttttttttaacaggatctcactctgtcacccaggctggagggcagtgatgtaaacatagctcaaactcctggacttaagtggtcctcctgcctcagcatcccgagtagctgggactacaggtatacaccactacacctggctaatttttaaatttttgtagagacagggtcttgctttgttgcccaggctggtctcaaactcctgggctcaagcaatcctcccactttggcctcccaaagtgctgggattacaggcatgagccactgcacctggcctctctttctaatcttcagggtcatttagaaacttatagtcaattccactgaaacactgaaaggtaaagattctcaaggtccatgtatagggaggaaatgatgggccctattcatgagtgaccaagggtgataaaagagagaacataagccggtcagtttaactagaaaaaatttgacagctcttagaagagagaagatggaggccgggcacggtggctcacgcctgtaatcccagcactttgggaggctgaggcgggcggatcacctgaggtcaggagttcgagaccagcctggccaacatggtgaaaccctgcctctactaaaaatacataaattagctgggcatggtggcaggtgcctgtaatcccagctactcgggaggctgaggcaagagaatcgcttgaacccaggaggcggaggttgcagtgagccaacatcacgccattgcactccagcccgggtacaagagtgagacttcatcgcaaaaaaaaaaaaaaaaagggagagaaagagaggatcaagtccccagatggagaggaactcagacagcagggtccaggcccaaggaagactacattgtaggaaatgaccaaaggaactcctttgggggaaatttctaaggaaggtgtcactaaatgggatatgacagaagttaataactatccttcggctttcgtgttattgtcaggtacttcctctatttttttactgtttatcattcattcctttccctgggcttctgagcctcaagtgttttttcactgttgcatttcctcctacttggaccagcttatttattatttgtttgtttgagatggagtctagctctgtcacccaggctggagtgcagtggctcaatctcagctcactgcaacctccgccttccaagttcaagcaattctcctgcctcagccttccgagtagctgggattacaggcatgcaccaccacactcagctaatttttgtattattagtggagacagggtttcaccatattggcaaggctggtctcgaactcctggcctcaagtgatccttctgcctcagcctcccaaagtgctgggattacaggcgtgagtcaccacgcccagcctacttagactagtttataaattaacattatacaaaatatatgaaaggactacaaatgtgcatccagacaaaggaacagaggagtgtgtgtcactctgcaaggaggctgcttattccaggacctgcctgcaccccagagtcagccatccaaggagatcacacacactctgcagacactggtgataagggtctgggagcaacacactaggttactttatgtcagaggcaaagggaaaagaaattgcactttcttctcataacaaactccagagtgctcacttgggagactgacagcccaacaaatacaagtgacaaggaagcaatttcaggaatgtaataagggagaactagctaggtttaaaatgtattgctaaagagttatgcaatttttgacttgtaagaaacttaaagaccccatctcatctaaaggtcacaaacagcagccttggagccaaatctggcccacagatgtgatgtgttttgtttggtgcatagtttgaattagttgtcagcatttaaaaaagaacagttcacattttttaaaagtccagattcctgattactgctgggaaaccagaaaatctgtggatcctacattgccagcatttcccggtggcagtacgaaaagccgagcagtgatcgtgccctttggacgttgctcgagtctgcagtttcccacagtccctggctggcctcctttaattcatttacataatctgtctggactctattggcagcttttgagtttaaagcccttgctaagccaacctgttcatttttatagataagaaagcgaggccctgagaagccaagtgactcacccaaccatacgcctatgttggtgtcgtttccatacattcctttttccatcccatgctttctcacttacacggtgaggtttatttagcaaaattttgaaaagagatttggaaagcaaacataaatggtgaggttaaagtctgaagaaactatgttgaaagccggaaaacacaaaggtgatgttaaaaagaggataatttagaggctcgctaactggaactcaagagacttccaataggaaattgttaatgagaggaagtggaaggaagagagaggttacaggcataataagaacaaatgagagaagcgtgagctaaggtaagatgatgagagagagtaaaacaggcactgttttacttgatctgctcccatacagaacaaaagcagcagttgacagaaaggaaactgacaaaataaatttcaaaataaaaactgatcagaaaaaaattagcaattataggccgggcatggtggttcacatctgtaatcccagcactttgggaggccaaggcgggcaaatcacgaggtcaggagtttgagaccatcctggccaacatggtgaaaccccgtctctactaaaaatacaaaaaattagctgggcgtggtggtgggcacctgtaatcccagccactcgggaggctgaggcaggagaattgcttgaacccgggaggcggaggttgcagtgagccaagattgcgccactgcactccagcccgggcaacaatgtgagactccatctcaaaaaaaaaagtataaaagatgtcttgttcagatctatttatttggggaaaaaagacatgaagaaaaggagaggcagcttctcaagattgcctgagatgttattaacaacaacaacaacaaaaaatgtaaacaaaaaacaatttcaaaggagagcctcaccaaaaaaagagaataataattttaaaaatggggataaaaaataattatctcaaaaaaatctccacaagaaaaaaaataaaattcttcctgaaactgaagcatactagaatatgcaaccccaaaatatgtcactttggcacacaggttatttggagctaaaggcactagagaaccagcagaccaagtaaaagctctttacttccccctaatcacctaacatgaactataacgtcccccttttgtacagaaaatttacatttataaaggaaatttccatttgtaagggaagagagctgctcctggagacagtagttatcacccgagagactcttatctgcataacaatacaaccgttatttactatacatttcttcccctcaccttcctagaactttcctcctcccttcagcagcccaaaaccccttttcctctgctcagcctaagatggtacagaagcttaaatcatctggctgccactttgagtcttagttctttgtggaaacttccctgcataggtatgtaatttagccgtccttctcttgttagtttgtcttttgtcagtttaatctccaaggccccagtcagcgaacctaggaaagaagagggaagtagtcctcctcaccaagagttttggcaaccattaagggacagcaaggacatctcacttgctcaggaggctaaagttgagatccaggatctctgacaaagtcggcaaaaggcaaaagttcttactaaagtcaccctcctgtatttctgtctgtagagtctgactgaaggaggatagtagaagtctctttgtcttttcctttccaaatttgcattagcaagagaaaaatatttgtaaaatttagttctttggatggtgactcttgtaaatttggtttttttcatgtgcgtccatgtgaagagaccaccaaacaggctttgtgtgagcaacatggctgtttatttcatctgggtgcaggcgggctgcgtccgaaaagagagtcagcaaaggtggtggattatcattagttcttataggttttgggataggcggtgaagttaagagcaatgttttgcgggcagagggtggatctcacaaagtacattctcaagggtatggagaattacaaagtaccttcttaagggtcggggagattacaaagtacattgatcagttagggtggggaagaaacaaatcacaatggtggaatgtcatcagttaaggctatttttacttcttttgtggatcttcagttacttcaggccatctggatgtatacatgcaagtgacaggggatgcgatggcttggcttgggctcagaggcctgacattcctgctttcttatattaataagaaaaataaaatactgttgaagtcttggggtggcgaaaatttttggggggtggtatggagagataatgggcgatgtttctcagggctgcttcgagtgggattggggtggcgtgggaacctagagtgggagagattaagctgaaggaagattttgtggtaaggggtgatattgtggggttgttagaagaaacatttgtcatgtagaattattggtgatggactggatacggttttgtatgaattgaaaaactaaatggaaaagtctaagaattgggaggacctaggacatctgattagagagtgcctaaggagattcagcatagtcctgccagtaaagattatttatttacttcaagagttaagagtggcagtttggggatagcaccaggagatatcagctgtgatggctcggagaaacagtgtaaaccggcagtgtaaacaagagcagggcatgtatgagtagttgagaacggagaataggagtatgactagacagaaaatagtagggatgacaagttttttggggcacagtctaagttggtccagtgtctggaatgagactggggcctaacaaaaaggagctcaaatgggctgtaccttgtagcattccgaggacaggcctgaattctgagaagcaaaagtggtaaaagtattgtcctttttaatttggtggctgagcttggtgaggtgtgtttttaaaagacctttagtccgttctacttttcttaaagatggaggaccataagggatataaaggtttcctgaatactaagagcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggcattttagttatctgacttggggcatgttgagtaaagctaatttgccagtcctgggtgggggcaaatcttcaagcttgatgtgtagggaagggagggggcctgaataatccctgaggagtagtagaatagcagatggaacactgagaagttatttccttgaggatagatttccacaatggaaaggaaatgagaggttctaagaggcgggctagtggcttgtactatagcatagcctgcctttgctggtgtgtggcgattaggcctggtggaactgccatcaataaatcaagcgtgatcagggtgaggaacaggaaagaaggaaatatggggaaatgcggtgaatgtcaggtggatcagagagatacagtcatgggggtcaggtgtggtatcaggaataatgtgggaggccagattgaagtccgggccaggaagaatggtaattgtgggacttaacaaagagtgagtacagctgaaggagccagggagcagaaagtatatgcatcaggtatgaggaagaaaatagattttggaagttacgagaaatgtggagagtaagttgagcatcgtttgtgattttgagggcctctaaaagtattagggcggcagcagccactgcacggagacatgacggctaggctaaaacagtaaggtcaagttgtttggacagaaaggctacagggtgcggtcctggctcttgtgtaagaattctgaccgcactaactatgcctaggaaggaaaggagttgttgttttgtaagggattgaggtttgggagattaatcgaacatgatcagctgggagagcacgtgtgtttttatgagcattatgctgagataggtaacagatgaggaagaaatttgggcttgactgaagtaatgggggctgtctgtgaagccttgcggcagtacagcccaggtaatttgctgagcctaatgggtgtcagggtcagtccaggtgacatcgaagagaggctgggattaagggtgcaaaggaatagtaaagaaagcatgtttgagatccagaacagaataagggattgtggagggaggtattgaggataggagagtatatgggtttggcaccatggggtggataggcaaaacaatttggttgataagatgcagatcctgaactaacttgtaaggcttgtctggttttaggacaggtaaaatgggggaattgtaagaagagtttataggatttaaaaggccacgctgtagcaggcgagtgacaacaggctttaatccttttaaagcgtgctgtgggacgggatcttggcattgagcggagtaagggtgattaggttttaatgagatggtaaggggtgcatgatcggtcgccaaggagggagtagaggtatcttatacttgtgggttaaggtggggagatacaagaggaggacgcaaaggaggctttggattgggaagaagggcggcaatgagatgtagctgtaatccaggaatagtcagggaaacagataatttagttaaagtgtctcggcctaataagggaactgggcaggtggggataactaaaaggagtgcttaaaagagtattgtctaagttggcaccagagttggggagttttagtttagaagcctggctgtcaatacgcacaacacttatggaggcaagggcaacaggcccttgaaaagaaggtaatgtggagtgggtagcctccgtattgattaagaaggggacggacttaccctccactgtgagagttacctaaggctcggcgtccgtgatggtctacggggcttccaaggctatcaggcagcgtcagtcttcagccgctaagccgagaaggagtcagtcagagagccttcggccagagttccaggggctctgggagtggctgccaggtgagttgaacagtctgatttccagtggggtcccgcacagatgggacatggcttaggaggaatcctgggctgcaggcattccttggcctggtggtcagatttctggcacttgtagcaagctcctgggggaggaggttctggtggaatgccgggctgctgcggttcaggcgtttggaagttcttatgtgctggagatgtggctggggtttgtctcacagtggaggcaaggaattgcaacttttttctattattgtacaccttgaaggcgaggttaattaaatcctgttgtggggtttgagggccggaatttaatttttggagttttatttaatgtcgggagcagattgggtaataaaatgtatattgagaataagacggccttttgaccttttagggtctagggctgtaaagtgtctcagggttgctgccgaacgagccatgaactgggctggatttttatatttgatgaaaaagagcctaaacgctatctgatttgggataaagaaaaaggagcattaaccttgactatgcctttagctccagccacctttttaagagtaaattgctgggcaggagggggagggctagtcatggaacgaaactgtaagccggaccgggtgtgaggaggggaggtgataaaaggattatagggtggaggagcagaggctgagcaagaattgggacctagctcagcctggtgaggagcagcctggggagaagggaagaggtcagatgggtctgtagaaaaggaaaattagaaagactcagcgacgcttggggttgggactgaggggacaggtgggagggaaagaaggaagatttgtgatgagttgcattgggaacagagactggaaagggaccgatgtgtaaaagagtgcctggacgtcaggcatctcagaccatttgcctattttacgacaagaattatttagatcttgcaggatggaaaaattgaaagtgtcgttttctggctatttggaactactgtcgactttgtattggggtcaagcggcattgcagaagaaaataagacacttagattttaggtcaggtgagagttgaagaggttttaagttcttaagaacacaggctaagggagaataaggagaaattgagggtggaaggttgcccatagtgaagcccagagaaaagagagagtagagacatggagggaaggggttcgggggttcttaccctccagaaaagcgggaaaggggtcagggcacagagatacgaggtcggggtgcggacataagggattggggcgcagagatatgaggttggggtgcggaaataagggatcggggcacagagatataaggggttggggtacttgccccttccccagaaaagcgggacttgccgctaagggtgaaggaccaaggcaggcgtccctgcgtggtctgacacctgaataatcagaaaggcatcccagcaatgattaaacaccaagggaaggctgccttccctattccgtgactggtgccggagttttgggtccacggataaaacgtgtctcctttgtctctaccagaaaacaaaaggaattgaaattaagagaagggagagattgaagagtggaaaggagaaagtggttgagggtttagtgagagaggttggagaagagagtaagaagaggccgcttacccgatttaaaattggtgagatgttccttgggctggttggtctgaggacctgaggtcataggtggatctttctcatggagcaaagaacaggaggacaggggattgatctcccaagggaggtcccccgatctgagttacggcaccaaatttcatgtgcgtccgtgtgaagagaccaccaaacaggctttgtgtgagcaacatggctgtttatttcacctgggtgcaggcgggctgagtcccaaaagagtcagcaaagtgtggtggattatcattagttcttataggttttgggataggcggtgaagttaagagcagtgttttgcgggcagagggtggatctcacaaagtacattctcaagggtggggagaattacaaagtaccttcttaagggtcagggagattacaaagtaccttcttaagggtgggggagattacaaagtacattgatcagttagagtggggaagaaacaaatcacaatggtggaatgtcatcatttaaggctatttgtacttttgtggatcttcagttacttcaggccatctggatgtatacatgcaagtgacaggggatgcgatggcttggcttgggctcagaggcctgacagttttgagtactcattggttactgatctctagcttcctaagaatagtcattgttttcctttgtttctgtcctttgtgtgatttattataatgaggagaatagtcatagttttggagaattgtcatagttataggcataggccctataagcctgctgtttaagccagcttcacagacccttgagtttacagtttatgctagagcagcatccatttagacaaactttgctgcggacaaccaatgggaaaaaactggatgagattcttcttttatctcattttgtgttctgagagtttagctttgtgactactatggtctctggtaatcagtctggtttctgccagctgagatggcaaggttgtcacacttgaattgggcagctagccaaccagctaggaacccaaagcacaaaatgcacaagcagcattttctttgaccaaatcttgcagctgtcaggagagtttgccttaataaggcaccccagtccattggggcctttattgtcattctttgttgccttgtttgtgctgggaaaagtaccatcccagtattacctacctgatatcacagattagtgagtctgtgattgaaggcatctcacttttatgggagactgtagtttccttattgactgcgacaatgaatttctttgcttttcaggctatctttgggagtaactctgaatcttggggaggaggagtgggtactgcctcctttgaaccctctttgggaaggtctcttatgtctatggttaagctgtaaaaaagctgattggtttagagtcacattggactaggtatacctttgaaaatttggactttatatccaaagggatttttttaagagagcttgcaccctaaaacaaatgtcctactggtactgataggaaaatcagattgcaagaaagacaaaaaaaattttaataactatttggaaacaaactagacaaaaatcttaaaagtcttgtgtattatttcattctcacattggtataaagaaatatccaagactgggccgggcgcggtggctcatgcctgtaatcccagcactttgggaggctgaggcgggcagatcacgaggtcaggaaatcgagaccatggtgaaaccccgtctctactaaaaatacaaaaaaaatggccaggcaccctagctcacacctgtaatcccagcactttgggaggccgaggcgggcggatcacaaggtcaggagatcgagaccatcctggtctaactcggtgaaaccccatctctactaaaaatacaaaaaattagccaggcgtggtggtgggcacctgtggtcccagctactcgggaggctgagacaggacaatggcgtgaacccgggaggtgaggctcacagtgagccgagatcatgccactgcactctggcatgggtgacagagcgagactccatctcaaaaaaaaaaaagaaaaaaaagaaatatccaagactggataatttagaaagaaagaaggcttaattggctcatggttctgtaggctgtacaggaagcgtagctgtttctgcttctagggaggcctcagggagcttacagtcatggcagaaggtgaaggggaagcaggcaggtcttacatggtcagaacaggaggaagatggtggggagatgtgtgctatacacttttagaaaagccagatctcataactcacttactcactatcataagaacagcatggaggggatggtactaaaccatttatgaggaatccgcccatgatcccatcacttcccaccaggccctactgctgacacttgggttaatagctgaacatgagatttggtggggacacaggtccaaccatatcatcttctctacaaatactggtgaaagattatagccattatttagaagtttaccttaacttgttccatctgccaagaacacaaagtggatccaaatattttacataaactagtgagttttgtaatatgatgcctgactcatggttaaaagtttaaaatgaaagctatgagatttctattggcatctgtgtgcttacatatgcttatgtgtgtattttgcatattgatcgttttctacctccggatggtattgccaaaatttatcaaagagctctgcattaattggcttagaaaacaataactgctcatatacattaagtattattaaaatcctcagaaaaaatagaaattaacccaaaatttgttttcaaattcacatgctctgggctaatctttggtaaataacactagttcagtattgttagttaaatacaaataggtatttctctagatttgtcagcattcaatataatgtagacatgcaattttattctacttgagtttactagccaaataagctgatgttatctctatttgatgttttggattataaaattataattcaaccaaagaatcaaatgtacaataaaaatgaattgcttgatgtatgtcaaagatggcagttaagaagaaagacagagagcgagagcaatataattaacttttaggttctttacttctgtgatttttgatagctacctcacatgcctgtcacaaatttgttaacaagaaaataaactttagatgatgattagctttatttaatcttgcatgaaattttcatcaataatccaaacataattgttaggaacaagttaattaaatagatgtaagtgggataaaactctatagctgaactttcaacaatagttatgttttataatatgtctgcttaaatatagtatctaaaatctttctggtaacctaaaacctcaaagatatagaaagtttagttaaatgagagatagtcatcaaatatttgatcatttctatatatgatataatactgaaaatttaattaagtttatctatatttggcttcttattacagagagactaaataatatttaagtctgttagtcaacatattcttcttgccacactgaaaaagtgtactatgaggaaacacatgcctctagaaattgtgaaagggtgtattcataaatatgctaatctacagaatgcccctatatataacagttcacaatttcctacttccttgttttcactggaaattaaggtattaatcattgaaaactctaatcaatatacataaatgaactattaggaataataagggtgaaggagaaaagtctacatgcaaagtatacaaagaaactaagatgtgttgggcacagggaggggaacatcacacaccagggcctgtgagggggtcgcgggcaaggggagggaaagcgttaggacaaatacctagttcatgcaaggtttaaaacccagatgacaggttgataggtgcagcaaaccaccatggcacatgtatacctagataacaaacctgcacgttctgcacatgtatcccagaacttaaagtaaaataaatttaaaaaaagtaagatgtgttttgacaaggaaatatatgaagtatgaaggatgcatttttgttaaggaaaagggagagtaattttgtcctacagtagtttaatgttatttaaagattatttcagagtgagaaagaggaaaataaaggacaaaaactaggcaggtataggaaattgtcaaaggagagagagagaattttgtgtagtcaaatatctaaaatgggctgggcacagtggctcaggcctgtgatcccagcactttaggaggccaagacaggacgatcactttagactgggagtttgagaccagcctacacaacacagagagacctgagaccctgtaaattagccagacgtgctggcatgtccctctagtcccagctactctggaggtaggaggatcacttgagcccaggagtttgaggctgcagtgagctatgatcgtgccactgcactccagcctgggcaacagagtgagaacttgtctctaaaaaaaaaaataataaaaaataataaaattattataaataataaaattaaatggatttattaaaatgtttaaaaataaactctaatatcaatagtgtgctgatgcagaactggaatttggattgttgatttgttcctaataagagatcataaaagggtttctttatctgttgagtactttgcataggaaacaaagattctgtgacttaccagaaataatttcccacatgtagtcccagctacttgggaggttgaggcaggaggaacccaggagtttaaggctgcagcgagctatgatcacagcactgcacactagcatgggtgacagagcaagaccccaaatctttttaaaaatttaataatttcttatgcttaatgttgtctttaccatatctttgattacttttttaaaaaagagtcttctcactatggaaaaagctaaggttttgttttggttttggttttttacaattatgtgaccttctgtatttacctttacagtaatattttccctttgattaaatagataactaagtattgtttcatagttacctgttatcctgttttatcaagggttcaaaccttttgcaatttttgatagtcttccccaaatcaaattctaaagtcttttaaaattttttttgttaaattttattttttaaaatttttatttatttatttatttatttatttgagacagagtgtcactctttttgcccaggctggagtgcactggcacaatctcggctcactgcgacctccgtctcctgggttcaagcgattctcctgcctcagtctcccgagtaaccgggattacaggcacccaccccgcccagctaatttttttgtatttttagtagagatggggtttcaccatgtttggccaggctggtcttgaactgacctcaggtgatccacccacctcggcctcccaaagtgctgggcttacaggcatgagcaaccgcacctggcccttcctcgtttttttgtttgtttgtttgtttttggtagagatggggtctctctgtgttgctcaggttggtcttgaactcctggccttgagtgatcctcccaccctggagcaaagagctgggatcacaggcgcatgagccactgtgcccagcctgattctgtagttttgttttttttttacttttgttgttgttgtctgtttgttttttgagacaaggtctcactctgtcactcaggctagagtgcagtggcgcagtcttggctcagtgcagccataacctcccagatgcaagtgatcctcccagcgcaggctcccaactagctggaactacagacatgcaccaccacgtctggctaatttttgtatttttggtagagatggggtttcaccgtgttacccaggctggtctcaaactcctgagctaaagtgatctacctgcctcggcctcccaaagtgttggggttaccggcatgagccactgcgctggccctagtctttttcactttgaactaactttgacattccacagaactctccttgaaaatctcaaaggatttgctctttcacattgaaaaaaagagatgttacactaattagatttatttgatacgctaaattacatgagaatcatcgtcaactaaaatatgatgcttaaccttctttatgttatatttgtataggtacgtaattaatatgtgtttcaaaactgtataaagttcctagatatttatcaatctttgctgttcatatgtcctgatacagtgttatctggacagttactattataaaatgctgtaagccacagaaataaccaaatttccttgttaattgcactataatgaactctcatcagatctttaatcatggttatttgtaagtcttttgccattcacagccaattattgttttatgataattcttctctgaatgcttttgcaatcaacaagtgaaaatgcttcatcttcccagagaccatggaaaagactcagagaggtattctcaagtatttaagattataccactggattgggtaaagatttccaaaacactaaagaagaaacatgaattcataaagctgcaaatacagcatcaagcaaaacaagaattaattccatgggactgaatgaactgataagaataattctaatgtgtatggcccttttgtttgaaacattactggttccttaatgtttttccatatttaagaaaccctttttctctgttttcttaagctatctataacttacagtaacttggtaaagtatacctttgtgaacaaagatgaaaagataaaacatttactttttttgagacagggtctcactctatcatctgggctggagtgcagtggtgcgatcacagctcactgcttccttgaactcctgggctcaagcaatcccccaacctcagcttcccaagtagctgggactataaatgtgcatcaccatgcccagctattttttttttttttaagagatgagagtttcactgtgttgcccaggctgaagtgatcctccagtgaagtgatcctccagtttcagcctcccaaagtgctgggattacagatgtgagccaccatgccccgccagaaacattcactttttctccccacccgatccttccagaattcggaaatctttattgaatattcttattttcatggtgatgtatttacatatgttcagtaagaatctcttgtccttataacagaatgcaatttgaaatattacttatattagcaaggctttcactggaatatcatattttaggatgatgcacataaaatcagataacatcagacagttttaaggaactgtcagaagcacttgaacaagagcaactccatcttgaataggggctgagtaaaatgaggctgagacctactgggctgcattctcagatggttaggcattctaagtcacagaatgagataggaggtcggcacaagacacaggtcataaagaccttcctgataaaaacaagttgcagtaaagaagccggccaaaactcaccaaaaccaagatggtgatgagagtggcctctgggtgtcctcactgctacactcccaccagcaccatgacagtttacagatgccatggcaacgtcaggaagttacactgtatggtctgtaaaggggaggcatgaataacccatcccttgttgagcatatcatcaagaaataaccagcagtgctggcgctgatctgtctatggagtagccattctttcattcctttactttcttaataaacttactttcactgtaatctatgaactcgccccaaattctttcttgcttgagatctatgaacccattctgggggtctagatcaggacccctttctggtaacaaaactaatgctgactttatgaagccagtgcttaaaaagccccttgaaatattggcctggtacctgattaacagggttcccaacctaacaggtgagtaaaaaaggtcacttcttggtaggcccaggaagctgaaaatattttggggacctcaagaaaaaaggaattcacccaaatctgtaggtattgctggtgaaggctgatggattggtttccagctttgataggctttaacagtctaacctgaaattccttattaaaagttgcaacaaagcagactcaaaaagagcttacattgtcaatcattattcttgctatttttatgtaataatcaggccaaggtcaatgagattgacttattttgcaacaaaaatagtgttactttgattatctttcatagaaataggggtgattgtagagagaactatgctgtttcaattgaaaactatagcacacccttgtggattgtcaaattctagccgtgttcactgcctttcagcttttttaacctctctgtaaactgactcctgctgtgttttgcattttgtcagtaattaacatttctgattttaatctcacctgatttggcaccactgagaactaaaacctgactgcctagatccgtattgacactacccagaaaaagccctgcaagctgaaactgggcccttccgtgctctgctctgagaaataaccataactgtcacattgtatatgccattcccagagacattcaaaccacaaacccagaaacacttcagactgccacggcccgtcctccttctatcacctagagatgcgttgagcccaacattcagaaatcttctcaactgattgccctctggcctcagaaactgggtttataaacagttctatctattaaccttggttttcttttgtttccatagaaaggtcctcattaaatgtcttacagcaccatatagagacctaaccggtgggcaccctattccctctggcaacacaatctcttgagatacaactttctgagtaaactgaactcttatacactgttggtaggaatgtaagctattcccaggactgagagactggttcagtgagatggggcaatgtgtttaaatttgtccttttctgcttactcactctcgttccaatctgttttccttccctttgcagatctcttatcttgcaacacctaatccgaatctctctcaacagctacaaacttggcttttgatgtatgaaacgtcctgagaaaaagaaagtttcaaagggtgggataaagggttccagaatatgccacccaatatatggattattttgagctaaaagcaactgagaaccaacagacacaggaaaggctctttctgtcccctaactgcctaaaagcagaatataaatttccccttttgtaaaggaaatttatatttataaagtaaatttctcttggtgaagattcctctgtaccagaaagagagctaggcctggggataacccatcacctgagacactcttacctgcataacccttatttacatacacgtatacatttcctgccttactttctcaggacttgtcttctctactcagaagccccaaacccctttccctttgtttagtctgagatgctatataagcttcaatcatctgggtctccttgagtcttttctttgtgatactcccacgtgtatgtatgcacataattaatctgtttttttcctcttgttaatctatgttttgttagtttaatttccagggcctcagccatagaatctattgggtagaaggagaaaaagttatttgtctcccctagaagccaaaatgcagtcctagccatagcaatcaagcaagagaaagaaaaaaaaaaaaggcatccacattggaaaagaggaagtcaagttgtctctctttgcagatgacatgattttatatatatgtatatatatatgtatatatatacatatatatatacatatatatacatatatatatacatatatatacatatatatacatatatatatgtatatatatacctaaagactccaatttaaaaaaaaaaaacctctaagaactgataaattcagtaaggttgcaggatacaaaatcaacatacaaaaatcagtagtgttctatacaccaataacaaagtagctgaaaagaaaatcaagaaaataatcacatttacagtagctacaaaaataataaaatatctaggaatagatttaatcaaggaggtgaaagacctctacagggaaaactataaaacactaatgaaagaaactgaagaggaaacaaacaaatgaaaagacatcccacactcatggattgaaagaattaatattgctaaaatgaacatactatccaaagcaacctacagatttaatgcaattcctaccaaaatatcaatgacattcttcacagatattttttttaaatcctaaaaatcatatggaaccacaaaagaccctgaatagccaaagcagtcaggacttaagcaaaaagcacaaagctggaggcattacactacctaactttaaaatacactacaaaactacagtagccaaaacagcatggaattgatataaaaacagacacatagaccactggaacagaatagagagagccaagaagtaaatccacgtatttatagccaactggtttttacaaagacactaaacacattgggaaaaggacaccatcttcagtaaatggtgctgggaactcggtaaccatatgcagaaaaataaagctggacccctgtctctcaccctatacaaaaattaactcaaaatgggttaaaaagttaaacctaagagcagaaactataaaactactagaagaaaacatagggaaacactccaggacatcagtctaggcaaagattttatggctaaaacctccaaaacacaggcaacaacaacaaaaatagacaaatgggactatattaagctaaaaacttcttcactgcaaaggaaacaatcaatagattgaagagacaacctgtagaatagaaaaaactatttgcaaactattcatccaacaagggtctaatttccaaaatttacaaggaattcacacaatttaacagcaaaaatataaataatccaactaaaaagtgggcaaaagatctggatagacatttctcaaaagcagacatataaatggctaaaagttatacgaaaaatgttcaatatcactagtcatcaggaaaacacaaatcaaaattgcaataagaaatcatccactccagttagaatggctattatcaaaaagacaaaaaacaacagatgttaatgaacgtgcagaaaaaagggaactcttatacaatgttggtaggaatgtaagctagtataaccattatggaaaacagtttggggttacctcaaaaaattaaaaatagaactaccatatggtttagtaatcccactactgaatatttatccaaaggaaaataaatcagtatatccatgggttacctgcacctccatgcttattgcagcactattcacaatagctaagatatggaatcaaactgccttcatcagtggatgaatggataaagaaaatgtggtatatatacacagtcattcttctattctctgtctccatgaaatcaactttttagcttccacatatgagtgagaacatgtgttatttgtctttctttctttctttttcaagacaagatctcactctgttgcccaggctggagtgcagtagtgcaatcaaagctcactgcagactcaacctcctgggctcaagtgatcatcccaccccaacctcccaagtagctgggactacaggtgtgtggcaccatgcctagctattcagcctttaaaaagaatgcaatcctgtcatttgcagcagcacagatgaaactgaaggtcattatgttaagtgaaataggtcaggaagagaaaaacaaatattcatgggtgtggtggttcactcctataatcacaacactttaggaggccaaggtggaagaattgcttgagtccaggagttcgagactagcttgggcaacatagtgaaaccccatctctacaaaaaaatcaaaaaattatctaggcatggtgccacacacctgtagtcccagctccttgggaggttgaggtgggatgatcacttgagcccagaaggttgaggctgcagtgagctttgattgcactactgcactccagcctgggcaacagagtgagatcttgtcttgagaaagaaagaaagaggcagggcacggtggctcacgcctgtaatcccagcacttttgggggctgaggcgggtggatcaccaggtcaggagatcgagaccatcctggctaacacggtgaaaccccgtctctactaaaaacataaaaaaattagccaggcgtggtggcgggctcctgtagtcccagctactccggaggctgagtcaggagaatggcatcaacccaggaggcggaacttgcagtgagccaagatcgcgccattgcactccatcctgggcgacagagccagactccgtctcaaaaaaaaaaaaaaagagaaaaaaagacaaataacacatgttctcactcatatgtgggagctaaaaagttgatttcatggagacagaatagaagaatgactgttaccagaaacttggaaggtggagaatgcaaggatgaagagaggctggttaacatgtacaaacatagagttggacagaaggaaaaagttctagtgttgggcagcacagtaaggcaactatagttaacaatatattgtatatttcaaagcagctagtagagaagatttgaaatgttcccaacacaaagaaatgataaatgttcaaggtagatttcctaaataccttgatcattacacatcgtatccatgtatgaaaatatcacatgtattccataagtatgtacaattattatgcatcaataaaaaaacttttaacccaaaatgcaaactggagaattttacaaagaatttgttatttaagggttcagcaaaaggttttctagaaagaaaaatgaacagacggcacaagactcttttgcttcaggagaggaaggatccaggcccggtactgctgcaagacagcaggatttataccaaaaattattgtgtaagtttactataaatattaatagacggaagtcgcagagttttatttaagatcctgaccagtgccaaaacaacagggaggcagtaatgtggactgttaacaaacctcagaagaaacaattggatatgtgtgtaattcacatacaaaagtgagcagagtagggtgtatgtcttttctgtgtcactgatgggttgggtcactccgggacaaacaattcaattctctaaggctcagtttcagccatgaggtgaggaattgggctgattctcaaagggttatccccagaccaaaatcatcagcatcaccagggaacatattagaaatgcacattttagctgccttcctggacttacagagtcagaaactcagggcgagtgtggtgactcatgcctgtaatcccagcactttgggaggctgagatgagcagatcacctgaggtcaggagtttaagaccagcctggcctacatggcgaaaccccgtctctactaaaaatacaaaaattcgctgggtgtggtggtgtgcgcctgtaatcctagctactctggaggctgaggcaggagaattgcttgaactcgggaggcagaagttgcagtgagccgagatggcaccactgcacttcagcctgggcaacagagccagactccatctcaaaaaaaagaaagaaaaagaaactcaggatggtgtccttcaacctatgtcttaacaagctctcttggtggcatccagtaaagcttgagaaccactgagcaagccactggacagatgatctctaggtccctaatagctataaacacacaaatttaattgtaagctaaggaggaaaattataagctgagtggtcctagtatttggtatagtaaatttttaaaagatattcaaaagaatgacataattatttttggaatggtacgaatgtttgccattgaattttacgagatgtgagaatggcgtgtacacatacaaggagtattccaaccatgaaatgacctgagttgaaataaagctaaagactacaagtgctaagacaaggatggtcacatacgcagtgggagtaatttccatacgaggaatgtacataccaagactggctcagtgtgcggacagccaagggaagtggaactttcagtgttcaaagttctacagtttttttaaaatacacgtatagattagttaatgaactactttataattagctgctttgtattaacattgcaaatgtttaaaaaaaaaatcttctaggctcattgaagttttagtggtatcatagggcctaaaactataaaacaaaagaaatcaacttctctctgtccaggcttagttgaagataataggatctgaaactgagaggttttagtttgatttatttctttctttgtttttgagacagggtctcattctgttgcccaggctggagtgcagtggtgcaatcacagctcactgaagcctccacctcctaggctcaagcaatcctcccatctcagcctctcaagtagctgggactatagatgcgtgccaccatgcctggctatttttttattctttgtagagatggggtcttgccatgttatccaggctgttcttgaactcctgagctcaagcgatccaccagctttggactttcaaaatgctgagattacaggcatgagccactgcacccagccacatctagtatgacttcttttttttttttttgagacagagtctcgctctgtcgcccaggctggagtgcagtggtgcgatctctgctcactgcaagctctgcctcctgggttcacgccattctcctgcctcagcctcccgagtagctgggaccacgggcccccgccaccacgcccggctaattttttgtatttttagcagagacggggtttcactgtgttagccaggatggtcttgatctcctgacctcgtgatctgcccgcctcggcctcccaaagtgctgggattacaggtgtgagccaccgcaccaggcctagtttgacttctataccatcctgtttctggccttctcccttcaccttcagatacctgctctttaatttattttccttgtcagtcatgtgtgttggttaattcattgactgcttacacttgtatatgaataaacttcacaatgctctttcaatcaagcattttcattttgtttttaataatgaattctaaaaggaaagatcctgtctatctattaaaggagctccagatatctcttaataggtagggaaattgttggaaggagcagaaaagcctccaagacagtaagagttcttaaagtagactgagtgaccttcttggcgtagggttgggaatagcagttgtagaggagatggtaaaggacgcagtccaggaaattgtggtaaaaattaatacagaatacactggctgctttgctaaggaactttctcccccagcaaggacaatctgccaggtggctaggcaagatggtctgtatttgttgtcatgaaacctgtgtggagtttcttccaggagtgaagccttcctgccctacagttcagctctcctgcctccttcctgcttctgtgccccatcttttcatgcatgaatacagatcagcttctctctccttcccctaatcataatccatctgctgtcccaggagccagggctgctgtgtcagttctttgagtggtgccctacacaaaagaactggcttaagtggcgccctgccaagtggactaatgaaggctgaaatctagcccatgcttccctcaccaaaccctgagcttgtgggttacttatttctaactcacacagaggtactctatgggctagctgcaaccatggcataacccctgtgttgtgttttgggacactatagtagtgctcttaagaaacaaaaacaaaaaacaactcctcttaacatactctctagaccgagccatgcttttcatgtcctctgtaaaacacagtgacatgtgtctgtggcacacccaagccagctgttggtaggctgctcctagtatgccccgggcacctccactccctccagttacgctttatgtatacaccaagcatccttacgtgttcccagaatggtgtatacaccaagcatccttatgtgttcccagaatggtgtctgctcattgtgcttgttattttaattatccaaattaatgaatgaactgacaaaattgtgtaaaaaaaacagtgtcatggtttctttgaaaactaatttcaacacgttgcaaagattgaaaaagggtaagtagtagaaatagctgttgatttagttgtggggaggcagctataaaagattggcaaaagaaaaatgcaatgcctaagattctgtgctctaattgctttacgtgcgttttgaagtccttgattcactttaaagaaactcaagcttagaagtcatagaccatgaattatggatgtagtttatgaaaaaaaagatgtgtcactataatcagcagacccatgctaaaaataataaaatatatcttttcaaaaagctttggccctacattaaaaaacatatatttagatgttttaaggtaaaacacaatgttcaagatatgtgtgtgtattattttagtgaatttttctattaatcgattgttgactatacccagttcagatcatgtcatataagacttctacagtattttattttgtgcctaatgagatttgtgtgtggtggtagactgttgccctttgtgatgcctttctatgtaatttcaaatatgctatattatatgtgcctttggtaacagtatttctgacaacaaagcaatattgtctcacaagaattctcagtaacaatcatacaatcacacctaggccaatccaaaatattttttaaaagcttttttaagtctagtttgacttctaaaatatactttactacagattaccacaagacacacatttggtctggcaaccactgaatcaatatttggcacctctgctgggaattttgtaaaaattgccttttaagttcaaactgactaggaagctagtaatgtattcacttctaaaaaaaagaaagaaagaaacctcggtataacaaactcagatcctttcataggaaggataatttaatatgaggttaattattcattaagggaggaaggaagaagactagaaaagaagttttgtttcatcatttcccaaccatttggaatcaaataattgtacaacttgggaagtgcggaggaacttacaagtcagaaagctgtacctttatcctatagcagaaatgtcttcttcagatcaaatggttccccactctgttttgttaccaatagtgagatgttcccaggtctagaaaggcacatgctttattgaaaagctcaacttagaaaaatcctttcttggccgggcacagtggctcatccctgtaattccagcactttgttaggccaaggcgggcggatcacctgaggttgggagtttgagaccagcatgaccaacatggagaaaccccatctctactaaaaaaattaaaaaaaaaatttatctgggcgtggtggcgcatgcttgtaatcccagctactcgggaggctgaacaggtgaatcacttgaacttgggaggtggaagttgctgtgggccaatattgcgccactgcactccagcctgggcaacaagagcgaaactccgtctcaaaaaacaaaacaacaacaacaacaaataaaaaaaaaccagaaaaattctttcttagagtgagtgctagtctgtcactttatcatgtccactttggggtattagttctgaaatttgcagatttgaacatttccacccttgtatattttcagagaactgagtatatttaacctggagaaaagatgtatgcatgtgtcctagagggattggtgtgaagggtacataaggaaaaactacctagctattaattttgcaatggaaacattgtggaggtttgccttaaaaagtagtgagctgaggtgttccaggagagagcagtgattatttactgagaggtctttagggtgagattcttactggatagaagattagaataagaagcctctcaagttacataatttgaaaagtctatactatacttggcattcaccatgacattctactctatagcatatttggtttctccaaattttcttcgtatgctatagcttccagatctttttacttttctagtcaatctgttatgaaaacatattaacgtaataaatatcctttaaattttatattcaaaattaatttttttaagagacagggtctcactctgttgcccgagctgaagtgcagtggtgcaatcgtagcttactgcaaccttgaactcctcgcctcaagtgatcctcccacttcagccccccaagtaggtgggactacaggtgtgcatcaccaaccccagctaattttttaaattttttgtagaaatggggtctcgctacgttgcccaggttggtctccaactcctggcctcaagcaaccctcccacctccacctcccagaatgctgaaattagaggtgtgagccaccatgccagtccccaaaattaaattttataatcaataaacatgatgcaggaatgaggtcatgaggaaataacctctctgtggggaccctgatagtgttagtaaaaactaatatgaaattaactgctgctaaagagccttggaaaacacagatttccactaaagtgatgagaattcatccttaggactggaatgcaatttacaaatcaataagtgaataaattattttgtagcttatttaaagaaatataggtcaagaatcccatatctgcaatcccaaaaaaatattaaaaacaagtttttttcataaccaattgagtggcagaacctgatgtaaactactggaggatacttaattatttgtatttatcctcttcacacatttggctgctgaactatttgagtgtttgacttggaagtgtactatatggcctttctaaatccaaatatccgaaatcaggagcacatctggccatacaattttggcttgggcactaggaacctgtctcatacgtgaaaggagactgatggtgggtggtatctgtgttatccgcaagaaaaaggaaaagggattccactttgaatagcatggtgtagcactctgaagggcacaataatacaaataaaaacaattagatactgaataaaacctacttttaattccatgttgggggccgggcgcggtggctcatgcctgtaatcccagcactttgggaggccgaggcaggcgaatcacgaggtcaggagatcgagaccatcctggctaacacggtgaaagcccgtctctactaaaaatacaaaaaaaattagccaggcgtggtggcgggtgtctgtggtcccagctactcgggaggctgaggcaggagaatggcgtgaacccgggaggcagagcttgcagtgagccgagatcgcgccactgcactccagcctgggtgacagagcgagacctcgtctcaaaaaaaaaaaaaaaaaaaaattccatgttgggcttacaagcagtaatggaaatctcccacctacccctccttctgcccacactaaccacagagtaaatagaaatagaccaaatacattccaaatcaaggaaaaaaaggggaaagaagactttaaaaaccagtcattccgaagatttcaagataacatattagtcacaataggctacattatgccgtggtgataaattaacttcagtactcaccaacatcacagaaaatttatttctcactcttgccgcataccagtgcaggctggtaggagactctgctgcacatagtcattgaagggcttgattgatagacgcttttccattcagcatgttgtaagttgttgcaacaggataaaagaacacatggagacccccaaattcaaactcagccttggaccagaagtgacacatgtcactttcattcctattgcccagcatcattcatgttgcctcctctaaatgcaggtgtcatgtagggcagacaagaaatatttgctgatcattactgtctcttccataaaaggataaaagagaaacagcaaaagtgagaaaaatagaaattttaaagtgatgcagtataaacaaatccaaataaatctataatcacaacactcaaaaagcaagtaatgtcataatagatctttaacatctacttatatgttcagaagagacccacctaaatgttagaaaaaataaagcttgaagtttagaagacaagaaaaggatgtaataagcagatataactaaaagaaagccaatgtggctgtatttttatcagaaacatataaaattcagactaaaaaattattaggtataaaaagggacactcataacaatttttaaatgctcagttcaccaagaagatataaaaattctaaacatgcatctaataagatagtattaatggtatcaaattatgtaaagtaaaaaattagtacagtgaaaaaaatgaatgaaacttacaaagcttaaaatacttactatctggccctttacagaagaatttgttgacctctgtacatgaccgtaaggtactttagcaatgttcaaaatattggcatcaaacaacaacaatctttgaaacataatgcaacaaaatatggagccaataaaaaataaataatcccacactcttgaaaatttaaaaggaaactatatttttaaataatgcatgggtgaaaggagaaataatgatggaaatttaagaatactatataccaaataacaaaactattatatattaaaacttgagaggtggctaaggatggccaattagaacactaataagggcattaattgcaacacattgaaaacagatcaaatatgtttcaattcatgagtttagatatttgggggaaaagctagttgatcaccttgggaagatgatagggaactatttaaataaagagagaaaaatcaaggatttatcatgcctttcctacatgaaccataccactgagcagtcagtaatgaatcacctgaaaatattggcacaaggggacaagttgaaacatgcaaggaaacccaagaggccagtcatttccagctgcccaaatgggactacagaaaggcagcttttagagagatctatggaaaactattgcctctgacggcagaacatgaaatttaaggagagtgaggacaagcttggttccaatggggacctctgcatccatcactacatccaactgccagaaacttccgaaagctacacctctacgtctgccttccagatttcatgcaggctcctcttttggccaactctcattcagaatcacaagagaaagggaattttggaaaatgtcatagcaattcagtgtagtccctctttttcaatttggtaactatatatcctcttttaaccacttccagataaagataatagcaaaagtatgtttccacttaagatggaacaggccttcatatacctaaaaagatattgatccagtctcctacagcagggacccctaacccccatgccatggaccagtactggaccatggcctgttagggaccgggctgcacagcaggaggtgagcagtgggcaagctagcattattgcttgagctctgcctactgtcagatcagccatggcattagactctcacaggaacatgaaccctattgtgaactgcatatgcaagggctctaggttgcatgttcattatgaaaatctaatgcctgatgatctgtcactgtctcccatcacctccagatgggactgtctagttgcaagaaaacaagctcagggctcccattgattctacattatggtgagttgtataattatttcattatatactacaatgtaataatgatagaaattaagtgcacaataaatgtaatgcccttgaatcatcctaaaactatcacccccacctcctggtctgtagaaaaattgtcttctgcaaaactggtccctggtgccaaaaaggttggaaccgctgccctaaaggatacacaaatgagatccatctttggatgatgtcgatttatcttttagcccactctcattccccctttggtacgctgtaacttaaatactaatggataaagttaatacgttatgttagatagcagaatgagagaaaaaagaaaagacgaacaaaggtggtgtgtgtttaaacatacgtatttaaataaattcatatcaaagaaaaaatacactcataactactaccaaactcatttctgcaaattggtcacatggtcatagctggtatttagagtttccttttcccactatccactcagcattctctgctctcaacaggcaccccagatttcctggaggatgacccaaaccttcattcctgaagggtctgtaacatttacagtcctgctgtattgggtgttgcagttttctatcaacttttcatcaaagtagtataaagaggtgcccccaaaggacctgttcaattctaatgatactcctctctgcttccatcatgtagtagcaacccaattttcccttaaggatcagaataaattatgctagctaggagagtaagccgcaccttccccttgcttttttttttttttttttttttgagacagaatctcgctgtgttgcacaggctggagtgcagtggcacaatcttggctcactgcaagctccgcctcccgggttcacgccattctcctgcctcagcctcccgagtagctgggactacaggcgcccgccaccatgcctggctaatgttttttttttgtttgttttgttttttgtttttgcatttttagtagagacggggtttccccgtgttagacaggatgatctcgatctcctgactttgtgatccgcccgcctcggcctcccaaagtgctgggattacaggcgtgagccacgtgcccggcccgtttttttttttttttttttttttttgccagtaggttcagtggcataaggagctaaaaatggccccattagagtctcagattctggtttgatagaactgctgttgtgttcccagtagaggcactcttcctttgggaactaaaacctctaaaacagcagataacaaagttgggaggatggaaaacccaatttttgctagcaggccattaaagttagtaataagaggagccaatcgcattttctccctttaattctctgacctgagggggaaaataagcaccacacagttattgcgtgctcagtgcaacaaattgcatcctgggacaggtgcagtggctcatgcctgtaatcccagcactttgggaggccgaggcgggtggatcacctgaggtcaggagtttgagaccagcctgaccaacatggtgaaaccccatctctactaaaaatacaaaactagatgggtgtggtggtgcgtacctgtaatcccggctacttgggaggctgagtcaggagaatctcttgaatccaggaggtggaggttgcagtgagctgagatcaccccattgcacttcagcctggacaacaagagcgaaactccctaccaaaaaaaaaaaaaaaaatgcatcctggaagacactactgtagccctgcaacgtgttgccctccagctgataccacagctgagtctccaaagggccatctactatcctatcaaccaactacctaaaaatgatgaggaacatgacaagcccagtggactttatgagttctagcccattgctgtaatttacttggcataaaattagtttcctggtcagaagcaatgtggtgtggaatattatgagggtgaatacggcattttgcaagttcggaaaggattgtttttccaggagcattgcaggcagaaaaaacaaatccatattcagttttgcccattggaaggatttcccttaagcactgtaccttagggcgccccttgagggcctgcagtgctgcagctgtccacttttaggtggtgcccgcatgccttgaaaaaccatctgtaatcaggcctgaattttctcttccttagtaaagtggacagagagaacttcccatgaggccatgggtgtggactgagagagagaagccaatttaatatgaataagagccataggaatctgagccagttacacatgcagcttacttatgactttgggacctacataagcccaatcttggatatattatttctacttatattggagtgctgctgtggacgcccaacctatggcttagtgagtcaaacaacatcaagttcataatggggagttcatattgcataacaacttgatagtccaaagtcaagcattcagtcttttctagggttcagtagcaaatcagaagctatttattaaaaagagaaagttaatctttagaagatggcacatagctttgcttcccagtcctgaaggtctataactcacagatagggtccagccaagggcccacacagtctcccaatctgtcagagacatttcaagtatcagtggatcttctgtatcaaagggctccgagggcagaggagctggcatgcagcgtggacctgttgaagagccttcccttgtgttaggccccactgcaaactggaagtccactagcagttgtgcttttttctttggggtagggctagatgcagcaacttgttcttcacttttgaagaggtatcttgaccatgtcccagatcagagggggcagtcactgaagtggagggctcctaaactttggtgaagttgatttctcgtcctctggctatttgctacttctcgcttatccagtccagtcaacagcgtagcatcaccataattgagtagaataataacttgtggaattgagaggcaatcaatgtcttttcagactagattataacagagggcttcagggttgataaaggctcaaaataggacagtggaggggtagtgctggccgtaacaattaaaagcagttataatctttaccatccatcctctaagccttttatcgtagcacattctctgcaatccctccaagaattctatgctgcctttgatttactattttagcaggtaggcacagttctagggactccttcctggacttttctatcataaaattccttactgcccataatatggtttaactgtgtccccacccaaatctcatcttgaactgtagctccaataattcacatgtcgtgggagggacccagtgggagacaactgaatcataggggtggtttcccccatactattctcatggtagtgaataagtctcacgagacctgatggttttataaggggaaagcccttttgctcggttctgattttctctgttgtctgccaccatgtaagataagcttttcaccttcttccatgattgtgaggcctccccagccaccctgcggaactgtgagtccattaaatctccttttctttataaattaccgaatctcaggtatgtctttatcagcagtgtgaaaatagactaatacggcccataatttggggaatcaatttgggaatctgccatttgctgaatatgtgaattccacctctgcattttagaattgggaaaataatcctagggttcaggtatccaccagacccactatgagttgcactcaggccaaaacctccacttatttcctgacctcttaaggccctactgtgactggtgcaccacagtgacattttgggtttctaggaacagtgctagtgtgcagcagtcctcccaaagtctacttatttcccctcccacaaggtacaatcacactgataagtggccacagatccctttgggaaaggatagtaagatttacaatacattttttgcagtctagcagcattcttccacaaaaggccttgcttccccttgattcaaggggctctgtgtctatggactagatcaggtgtggcaatcaatcagctgaggatccgggactgctctggaatttaactcaagacttttctactccacacctagaactttttttgtgtgtatataaatcaagtaaggctttagtaacccatcattttattttattttatttttgagacagagtctcggtctgtctctcagactggagtgcagtcgcccattcttggctcactgcaacctccaactctcaggttccagtgattctcccacctcaacttcccaagtagctgggattacaggcccgcgccaccatgcctggctaattttttggttttttttagtagagacagagtttcaccatgttggccaggctggtctcagactcctgacctcaagtgatctccccacttcgaccttaattctagggatatcaaaataaattagccaacaccaaagatcaaaccattctgattatcactttagttctgctgtccattattacaaccatgtttctcttgtccctagcagtaaagatagttacgtgatgtcacttggtgcctctgttccagtatcccactatccccagtgaattgtgggatggtggcaacattaatggcttacagagaatggctactatagaactccaaaagggttctggtgtttgcttcagcaatgctttctttctctctttctctttcttcctttctttctttccctcttttcccctctcccctccctccccctcccctcctctctcctttcctttccctcttcttgctttctttcttttctgtctctggctctctctctcttttctttctagtgatgagcccctaactctgttgcacaggtcggagttcagtgccaaaatcatagctcactgcagccttgaaatcatgggtttaagcgatccttccacctcagtgtcctgagtaactgggactacatatgtgcaccaacctgcccagcaacaatgcatttcttaaagctttgattaaaggagaccctcccaggtcctaacgaagggatcttacacaataaatccactccagcatactgtctgcttatcttttggataccttctgtttatagcaatgggagaagaattcatgaaagatgtagttttcaggtactacttaacagaaaacaaatggtttcgtagtgtgtgtgtgtgtgtgtgtgtgtttgtgtgaattttgaatatgaacaaggactaaaaatagaaattggaataatgaagtaaggattgtgatggttaattttatgtgtcaaattgactgggccaagatggccaagtagctggtaaaatactactttaagtgtgtttgtgagggtgtttctggaagagattagcattggaatcaataggccgagtaaaaatactgccttcaccggtgtgggtaagtgtcatccaacccattgagagccctaatagaacaaaagggtggaggaagggcaaattctgtcttcctcttcttgagctgggacatctgtctttttctgacctcagacattgaagcttttagtgctcagaccttcagccttgaactgggagttacaccattggctcctctccttctcaggcccttggactcagactcagactcaattataccaccagtttcctggttccccagcttgcagatggcacatcttgggactttttaatctccataattgcacaaaccaattcccataataaatctcctcttatgtatctatctatttatccatccatctatatcctattgattctgtttctctagagaaacctaatatagtgttttagcagagacgaaagattcaatagtgaaaatgaactacacaatttggtggtggaaaaagggacatggcaagaatccaaaccagaaaattgttacttctagaaagataactggaaatatagaggagaatctgtgaataaaacagaaaaagttggcaacaggcaatatatgaagcatagaagagatcaatatgtcaaaacttattctgaggttcattaattcaaaggttaacaatatggtggcattggtaagaaaggtggcgaagccataaagagaaaacatatggaagacagtagtttgaaggtcaggtagaaaaagatgtgacaaaaattgtgaaatattctaaaaatatagctgccaaagagtgggctgatggaaagttgattagtatatgcagtgactttataatgtgacaacttggctaggttgaactacattcccagaattccctttatgattctagttatggtgggccacagagggagagtctggagtgatttggagggtagatataaagcagcaaacatttttttagctcatgcacatggtcatttaactgttggctcacctcatggggatgagccagtgactggggctgcaactactccacctttaacatgatccttcttcagcttctgcaactcctgggccgggtatgtgggtgtttagttctgtggcaaaggactccagctcgtgtggaacacccaggccatcaaggtcagaggcaatgagaattaatatgggttttggttcactctcacgagatccacttcatgcttttgagttctagcttataatttgtttcacccactttacatccatcttctcttcccaaatggctgccttaaatatatttcttttatgatgtcagtcagcatgcaatcaaagaagcagaatacacacacacacacacacacacacttctgcttctctgattgtatgatgactgtataataaagtctttattatacagtatgccctaaacatacagcttagggcactaattctcaatatttaaaactccatgtcttatttggataagcatacacacttctcctctcctttcccttttcaccagttatgacagacccttcttaaggaaacatgcccattaggatgaggaatttctggtctggcatagatatagcgatagcatctgcttttgtagtttgtattgtttaacatgcaattactttcattttttcaaatataacattatatgataacgactataaattttcaaattaaatgcatccacttccacttttttgtttgttttttgtttttggttttggtttttttgcgacacagtcttgctctgtcgcccagtctgaagtgcagtggcatgatttcggctcactgaaacctccgcctcccaggttcaagcaattctctgcctcagcctcccaagtagttgagattacaggcatctaccagcagacctggctaatttttgtatttttaatagagacagggtttcaccattttggccaggctggtcctgaactcttgacctcatgatccacccacctcggcctctcaaagtgctgggattacaggcgtgagccaccgtgtctggcacttccacatgttcttaaatgttcatccttccccactctttgcccctccacatgactctttttggagaatgaagattagacatacaggtttgtctaatcatacaggtttgtgtgtagaaagtcttaagagatcgtaattcactctctaacacccaaaacaaaccagataatctaaataattatagtttaaaaaaatcggagatatgaaagcacaaagaaacataggtgaactaaacttcagaaagggacaatcattcaattgagaggaaagagccacagttctcatccctgactgaagtggaaagaggaggaatcaccataattaatggtaaggagaaagcagcctaactttcaacatattttaaagtgtgtggctgatgcgacaggttagaatacacaggagccacaggcacagagcaaaaccatactacctcgcaattatttctcattgatattcactaactcctggggtaggaccacaaaaacaagggcaatacagagttattaaaactttcagagacacattggggtttcagctaagaaagacttgtagagggacaagagagctgaaagaaaatccccagcactccaggctgtcagctaagaaagactggtgcagggaggggagagcaggagcagaaagatcttcccgtaagacctgaagctagggaggacactaaccagggcagaaaaggtgagaataacaactctaagacaatatttgcttataggaaaagttctaatcctgccttcaaaatatttgaagcctatagtaaattgaatcaaactaaagttgaatcaaagcccaaacccagcccaactccagatcatatcaactgagccccaacttccttcttggaagaaattttttaaatttaatttttaatttttaaatttaattcattgtctactgtatttttacataaaaatgtccagcacacagtaaaaaaatatggaaacacacagatacatataaaaaaagaaaatatgggccaggtgcggtggctcacgcctgtaatcccagcactttgggaggccaaggcaggcggatcatgaggtcaggagatcgagaccatcctggctaacgcagtgaaaccccatctccactaaaaatacaaaaaaaaaaaaaaaaaattagctgggcgtggttgtaggcacctatagtcccagctactagggaggctgaggcaggaaaatggtgtgaacccgggaggtggagcttgcagtgagccgagatcgcgacactgcactccagcctgggcgacagagcaagactccatttcaaaaaacaaaaaaagaaaatatgatctgtagtcaaaaaaggaaaccatcaggccgggcacagtggaacactcctgtaatcccagcactttgggaggccaaggcgggtggatcacgaggtcaggagatcaagatggtcctggctaacagggtgaaaccccgtctctactaaaaaatattaaaaaattagttgggcatggtggcagtcccagctactccggaggctgaggcaggagaatggcgtgaacccaggaggtggagcttgcagtgagctgagactgccattgcactccagcctgggagacagagcaagaaagtaaataatgaattacataggcttaacggtaaattggaaaaaatcagaggaagaaaacttagaaagaaataagtagaaagcgttcaaattgaaacaaggcaggtgtggtggctagcactgtaatctcactttgaaagctaagacaggaggattgcttgagaacaggagttcgagaccagcctgagctgatctcaaaaaaaaaaaaaaggaaatacaaggaaataaaacagagtatttgagatacatggaacaataatatatggtctaatacttgtattaagaataaaaaaaggaaacagaatgggtgtaaaaatattcaaacagataataaatgacaattttctaaaactaatgaaagataccaacccacagatccaataactgcagctgacatcaaggtgaataaatgataaatgcaaagaaaaccactcctgtgtacatcatagtcaaaattctgaaaacctaatttaaagagcagatcttaaaagcagctacagaaaaaagtgtacactgtacacaggggcaccaaaatatgtactacaagtgattttttagcaaaatatgaagtcagaagaggaatgacatgtttaaagtgctgaaagaaaagaaaatgtcaacataaaattttacgtacagtaaaaatacccttcaaaagtgaacatgaactaaagacatttagaggcagacaaaagctgagagacttctccaacaaacagcacacaggctatgctgagtgaagttcttgaggccaaagggaagataccagatggaaaaccagatctgcaaaaaggaataaaaaagtactagaaaggataaatatctgggcaaattaaaaagagacatactttaatacattcattatatgcatatatttacaaatttctaaataccataaaaatacaatgtaaaatgaattttataacatatagaagtaaaatataacacaacaatacagaggatgggagagggataaatggaattacattgtaacttttttacagattcataaaatagaataatattatttaaaggtagcctgtgataataacatacgcaaattgtaatttctaaagcaaccaccatatttaacataaagaagaaaatctaaaaagacaatctagtaatttaaatggaatatgaaagaaaaaaatccaatttacccataagttctcagaaaacaaggaacagagaaacaagcgacaaatggaaatgaatgaatgagaaaaacttccctcaaccactgttattgaacactgaatggctctgcaaataagcttttactacagactcaataatgtttctttatgaatttaacctaaaactacaaggcaaaatagagcttatatgcaaaacttaaactgcagtaaaatcattttgacacaactaacattgtttgaatcacaaataatgtcaagctgttttacacacttctcatgctgtcaaaagttaaaacaagaagcaagatctccattccaacacaaatttgcagcagttatgtttttctgaactcaaactacagtaccaacagtgttttctgaatttcaatgcaagtgcaaaggaaattttcatatttaaaatttacttaactgtgcaactgagaagcttccatttaaccttcaactggaagtgattaatctgcaatgtaatggcatgctaaaggggaaatatcaagagaatttatagaattctaatagaattttagaaatgccttctaagcaatgaatacactcaagtaaaatcatgtgctcatgggttggtatcagtatttggcggtatctgtctgggtagaaagacatttcaaaaatgaagtacataaaatctcataaaaaatcagcattaatagatgaacatctgcagtcaatttttatgaaagaacactttgaacaccaagtgaaatgttactttccccccaaaagaattccatgcctttcattattatacctgtattaaaattgctattattacactttgaattgacaaaataaaaaactgtggacttttttttcttcgtgttatataagtatctacctgacattctcaattttgtctcttggcccacaaagactaaggcatttacagctgggccctttacagagattggcaacccctggtctaaatgtagtttttgctacagttgtcaactatgttttttgctttggaaccacaaacattctacttcaaactactacttctatgaatcacttgtagacgttgaggaggagttaggaagaaaagtcgagaactaatttagtcctggggttaaataataattgtagccaacttgaattgagcacatatattgtgcagctctctgctaaggaggcatttgtatatattttcttatttaataagataatcttatgagctaggtactatttctccccattttacagaagcttagtgactgtgttgtcagggatcacattgctaagtgatgtggaagacataacctagcaatgggacatctaaaccaatgtctgcaacatcaattaagaaaagcaaaagaggccgggcgcggtggctcacgcctgtaatcccagcaatttgggaggccgaagtgggtggatcacgaggtcaggagattgagaccacggtgaaaccccgtctctactaaaaatacaaaaaagattagccgggcgcggtggcgggcacctgtagtcccagctactcgggaggctgaagcaggagaatgacgtgaacccgggaggcggagcttccagtgagccgatatcgtaccactgcactccagcctgggcgacatagcagactccgtcttaaaaaaaaaaaaaaaaaagcaaaagaatacagaaaattgttaaaggggagaagggggtggtcaaaggcagaggagtcggtgtggacaagacagagatctcttggagagagggcaggactaccagttgacaaaacctgttcaggttcctggaggctcacaaccaccagttcccatcatcccagcaacagcactctttcccaccctagcctcgttcgtaatgatctgatcaatgtgtgaacaaaaatattgtgtgtacaagtctcaacacatttgataatgtgaagaggtgaaggaaagtgggtaggaaaaatctgtagggtggggagactcggggaaatgtgtcctggtccagtgcaggtaacatatatgggtatatatgcgtatatacatatttataccatatttaatatattactctattaagaaattataacaaatttccttttacattacacatccacatattaaacccccaatatgtgctaacaaggttagaatttaagtataatgataatgttctcagttttttgtggtggacactttaagagagtgtaaataataataaaaataatagagtgatcagatcacttgtgctcagggctagacccttcagccccaacggccttaacccccctcaactgcttttccaaccaaatattcctccccctgcaggatcccagggccatccaatcaaccggccaatgacggtttcagagaagcggtcctggggaggggtattatctgcaggaacacgtcctgccaactttgtagtcgagtcacctatttcggttggtagcggccgctatttctttaaaagggcagtggatttcgaaacaggagggggaggtcaggaaaaggaactcagctgcctttgataactgccctgcagccttcccttcccggagcgcgtgctcggctcgggaagcgcccgcggccgccgcatccccgagcgggcgcgtggcgccacctctttccggggcgcccaccttccccgggaatccccccgcccgacggtcccccagcgtctgcggcgcggccgccccggctttgtctccggcgtcgcgctcgggcgcccgctctccccacatttccccgtgtgcaggctgtaacccgatctcccatttcctggtggattctcttaaagaggcagcggtcgagaagcagaacaaaggctattgttttatttcctccttcggattccgcgtcctaaccggaatggcccttcatagataattactttcgttgcatctgcgcttagtgaaacgtttcaaaacccttgtgcacatcgatgtatccaagagacggagccaggggaggtgggaggagtttaataaaacctgttttgtggtgtctggggccacaatgtaacgttttttaaaggtgtcttccttaagcccggaaattggctcggccagcgggaggtctcgcggcgtggagggcgggcgcccgcaccgggggccggcctggggggctgcgccgctcgccccgctcgcagccgcggccccacgcggccccgctacccgggtttcctccgcccgcgcccccgcggccgcccctcccccgcgcagcttttatttccccgatgccgggctgtaacccgagcttttatttcctggtggctcctttaagaggcagagctcagtgctgggaattcacgtcagtttctgcactgaaactctcaagatcaatgagcaaagagctttctcagttctgcctttcagtttctctcttccaggaaggaaaacattcgagagagcgagggagagccgcgggagggcggggggcgggggcgccggctgcgggtgggaggagagaccgggaggccggccgggctgcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaaggtaaaaatcttctcccctccttctacgtggtggaaaccctgagctgcaccggccagggcagtcgtgctgggctcctcagagcaggctgttgcagttgctctgttcgcaggaaattatttggggcgagagggaaagagatgcagctcgcggtggctgctgtaccctttagcgtaaccttgctactcccccccaccgccgagcccctgccggctcctcggcccccacccccttgctttttgacaatgaaatgccggtcacaattggtcagagcaacccggattgtctccagaaccgtaaaacacccccgtaattagtgcgcttaaaaaaaaaaaaaacaaaaaacaaaaaaaaaaaacctgctccctattcctacacccaacatgtgactgaaatataacttttgttcccgaggggtggtcgtcttagaaaaaaagttgttcagtttccactgcgatagaatctttttatttttttaaaggactctctgggtctgatcagacaggatttttttccccctcgtctgattgtaattgcaagcgctgtcggagagacagtcctggtgtcagcttttcctaggcattgcacaatgaatttttttttaaaaccaaggtgaataaagttgctgaatagttattttactccgatccatatgaaagttgagcaatcccaaagtagaaaactcctgtgatggagggagaggaagaactaagcaaccaggcaaaatgaccttctgtgtttgacagtgcagagaggctatctaagcagcactctgtaaatgcagggcggtagatgtttgtaaacacactgctgggctacccagtagttgtgtgtatgcatgtctatatatctgtaaagactgtggtgctgcggtttgttgcttctaaaaagttgttgtaaagtttgccaccattgggaggcaggatgatttatccatctacccgtgttatttttcccatcgctgcatttattgtacactttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcagaaaagatattcatgggtttgaggataggctaatgtgaaatcaaaaggtggtttgggcttctttgtttttgcctcacaaaaatgcctaatggaacttttaggcttttgtgtttgtacataactggaggtagcagtatgtatgtctgtgggcatggggcgtgccacactaaagaacttagggtactttgatattaatacttcaaaaccagtttcttttgcggtataaattagattctacacagagttcaggaaaatcctgcggtatagataatctaatttatttgacgcttcataacatagaggtaactaaatagtaggatattcaataaataaattgtatttggctcagtggcaataaacccgacatcaggaaaatctgccaactacagatcagtaactttagggcaaaaacaacaaaaaacaatgctttctgtgacgtttcttgatcctcttctatactgcatccccaccgttttgatgggcttatggtggtgtgctggctgcagactgctactgagtggtttgtttcattgtgctccagtcggaaaaagagtacaacagtcccttgccttactcacatacagaaccaatcccaagcaaaacgcgttcttaaatgcaacatgaaaattgtctgtaatttgcatatcatttttttccttattgcttacaactcagttctttcagggtgcctcttttcattactgtgtacttctatgtaattaaaatagatttaatgttctttaccagaaaggaaagaatcacttttattttggatcgttctttatggaacgagtatgtatttgcttagactgcatgtgtctaggtgaacgtatgtgaagagtatctttccatggagtttgtttaattcagtgttccaataataagcactagagatcaaggactgggattattccaggtcatctgaaatgttctggtgatgtgtgctgcgtttcatttagtccttgggatgtggtacggtgactgcataataaaaaatgtttgctggtaacccacaagcaagttgcttgcttctagagtccagtaaacaatatgcttttctgtgtagtgaagaacgaatgtcagaggttttcaaggatgagctgatgaacctgatataccgaactcctgtgacacaaaaggctctcactgtggagaggtttttcccagtcctcctctccactcctgaaaccgtcctcacttgctttcattccttacaagtagcgggtcagcaggcagacagttcctcagcggctggtgagatgcagccacagagggaagtactttgtttatttctgagcagtgcctgctctgctagaaaagagtagtgtccgatttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgacttgcagaaagcaggagtgctcgagcactcctgggggggtctgtcctacaacccttgaaggttgtggcactgttgtcatggaagttcaaatgcttcaattcctgaccatttggggtcgtttaaatggaaggaaaggatcaactctctataaaaagtcaaattgttttaaagaggattgcctggctgactgtgctggtcacaggaagaaggaagaggctgtcttttccatcatcagccttcaccttcaagtcacctcttcagttctaagtttgaccaagttgcagcggaaggtggttgtggcctagcagacacggtcccttgtcaggcttggcacagcttgttagtgggccaggactaaccagaatccaaaaacgagtcacacagtgtctctagtcccctccttccctgctgtccgtatcagtcagctttcatagcagaaggaaatctggtttttaaaattttgctactaactgggagactctttcgagctccccttctggactctgggctccttgggtttagtgatgattatcttggtgtcctagtagttagcttggcagctggcatagaaatatttctcagtaatgtttgctgatgtgaatgaagtgagaggtgggaggaggccagccccctttcctctttctgtctgcgtgtaacctcagggtgacgtaacactttcatccactggcttgcttgcagaaagcactcaatagggcccactacagccttagagagggctagagcactcctggggggtctgtcctcaaatgcttattaatagaattttgatacaataatgttttataatttttttttggagacagagtctcgctctgtcgccagactggagttcagtggtgcgatcttggctcactgcaacctctacctcctaggttcaagcaattctcctgcctcagcctcccaagtagttgggattacaggtgcccgccaccatgcccggctaatttttgtgcttttggtagagatgggggtttcaccatgttggcaaggctggtcttgaactcctgacctcaagtgatctgcccgcctcagcctcccagagtgctgagattacaggtgtgagccactgcgtccagcgtaatgttttattattttgataaaattctcaaaaactgcttttgtgtcaaaaataacaaagaaggaaattgaggaaaaggtacaacaaaggggcttaaggaattgctttaacaggttcagattagcaggcttctaagtgccccccagtttttctgacaatagaatcagggaactttcaaacattcagagttgagagaccttagagatcccctgggccaacctcctctattttttacagggaggggatccagagagctaaggggtttgcttcaacccatgggtgagtgagccaggtttggaggacacaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtctggtcaggtgtgagaagaggaagtagtaggagggaggagatgagagaagaagggcctgacggacttgtattggcaccactatttgcatcaatatatgtatatatatatatcttttacagtgcacaaaggcctgcaagttctgttttgggctgaaggccccctatctgctgttaggactcctttgaggaatccttgggtgggccgtaggctcttttatcaagggtcagacaatcctatttatactttaatttctgtgtagtaagctccctgtttcaaacagtcaaagctaaaaatgtggcagctggccctagagaagtagctatcctgctcaggataagtaagtcaagggcaaaaaataccccagatgtgagcaccagaggcaggtagagctaagtcacattctgctcctctgagtgcagctgtatttgtgcacaccaggaaagagctgggggcaaggtgggggcacagggttgctgagagtaactcacacagcagtttcatttttttcaccaatttttaaaacttgccctttggtgtggatctcccagccaagtgattcagtgtcagatgaagccccgtaaggtgtgccatatagaaatgacatgtttgttctatgtgaatactactttagagacaatcctggagcttgttttcaggtaagggtccaccacttccatatttgttgttagatgtgtgttgggaaccaatctccgtgtgtatttgttgaatagaatgagtgtgcatttactcagggttcccacgccaaaagggacccagcttaaagactgttcactgccaaacctagtatttggggacagaaagactagactaaattagtaaaaagttagaattatagcctattaaaaaacaaacacatttttattgattttccaaacatacaggaaccaaactaataaagtgttgcttactggggcatctcagggaacgttccaatgaataggcaagaatgtgttccacattatccattgggtagaaactagtgctacgatgtgcttggaactgttcctttagtgtcaaaatattaccacacattttatttgctctgttaatttgtttgataaccttttcttcttagtaaaaatacagagttcagcctggtcgttgtctaaatgatctggaattcccagagtgtggacgaggggcttgattagaaaaggtattgccccgtgttaagtgtggactctcagatgagcataactgctcactcagccctatggatttcgcttacaggaaacggtagaatgcttgcatttctgaaactttgtaaattctctgtaattaaaggtgttcgtctgctgttttagtggccgttgttctacaacaaccagttgtagcttacagctatatagtgatttattacaaaacactttcttcttctccttttccttcttcctcttcctcctcctcttcttcttcctcctccatcatcatcaccggcatcatttattgaatgctactgcatgctggtccttgtgctgttttatatacattatatacattatctcatttactcttcacagctctctatggatgcagtttttctctccattctacaaatgaggaaactgaagcccagagaggttaagtgatgtattggcctaagacctcgcaggctgtaagtggcaaagctaaggccagaatctctactgtgggactctaattccaaagtattttctatgagggcattccaaagtgcagccatttttgcgaagaaaattaggaaacttgaagtgacgggtggctggtggattgttacataagccgagatgagaggcaggaatagagctggcagaagtgcttgcagaggttctgaatttcctctgcttcctggtctcttctgaagatgggtcttcctagccattacacaagtagcggggacaaccagatggtcacacaaagccaccacccactgtggaatgaatgtctaagttttccatatttaccccagtctctaatgtcctctggtgaaattttgtctttgatgggtttcattttgggcccttgttgtttttctcagatgcctttcttttccttgtgtttttcttgcttcctccggtgcttaatggcttcttcatgaagcggttggaaatctgagagattgtgtcatcctgcccggcctcgggctagacaccttctttgcctgctttttacttcctggtcagttgcttctccttatacaacttttttttttttccttttaaagcttttcacacaatccataaacacaaatttttgtttttcttaaaccatctctcatgtacatctttaatattatgtgatttccaggaatctatttcagatattccctcattttcccctataacaaaaggaatcatctttttttgactcctgtctcgatggcttgacccaactcgcctgttctaatttcctggaatgaagagagcatttcggccatctgactttatacatttctgattttgaacgactctagtgaagagagtcttcagagcaaatgtagggaaagaaacagagaaagagagagatgtgttgtggagataatatgaggggattcagagagcattatccaaatttgtcatgaagcaaatgaggaaactgagtcttgtggcgtttaaagagcttgcctgagatcacattcctaactgatcaagccagagtcagaatcagtgttccatcctaggtccatgttcctctaacaccatagcagaggaaaaatgagaaaaaacaggcaagaattcagaaagcatagcttccttttgaagattcacatgacatattagtgttcatcattgtgacttccaagtgaaagacagagttcatgttatgagatttaagaagtgaagaaagaatgcaatgtattttggaaagatatctaacaaaaatggttggcataagaataatgttaagttttaaaaggctaagcttcagttacgtggatgaatgatttatgaaaagtactcccccatgaagacacaaaagaggtagccaatgcatctgcaagttcttgaggcctgatggcctccctgggggtattttccctttgtatgtgggagtcagatatacggaaaacgacttcatttcctgaatgacccaaaaaggacgcattgccctgctgagtgccagttggtgagtgtgctcaatggtgttagtgttgccacagtgtagttccagtcaccacgtctttcgattttgacttacattttcttctgtcttatgttgttctttggttcttacctgtaaagctgacttcccttcaggagattgtaaggtgctcagaaaagggctttacctcactgccatgctgtgaattctcctaggggaagagtacagacaatggagtagacagacccatgaatcctggttcctgaacttgaacttgttcaagctacttaatcatgaacctgttaactcatctgaagtggtaataaaaatgtgtctcttagggttgttgggatatgtacattgcccaatgtagtgctttatactgttaaaaagttagttctcctcctcctttatacatcctccataacacatggatctggaagaggctagagattttctggttctgtgcccacattatacagttgagaatacagaggccaggggatggtttgtttttgtttttgtttttgagacagagtctcgctctgtcacccaggctggagtgcaatgccgagatctcagctcactgcaacctctgcctcccaggttcaagcaattctgctgcctcagcctcctgagtagctgggattacagctgtgcaccactcacctggccaatttttgtatttttggtagagacagggtttcaccatggtggccagggtggactcaaactcccgacttcaattgatcctcctgcctcggcctctgaaagtgctgggattacaggcgtgagccactgtccccggcccccggccagggatgttaatggccttgctcaagctcgtgtggctagttggtggtgccatctgaactaaaatctaggcctcccgagtcagctgactccctgcacagtgctcttgtcactgtcccattgagttgttcacagggctggggtcactcagtcagtgctcaaaaaagctcttattttaactttaattgaatacaagcctcaacaataggagagatgagccaagtgcaattatatgataatagcaaatgccttttgcatcttacagcagaattttgaaggaatagctaatgtggttctgaataagtttccagagatgaaagaaaaggaaaaaacctaagtctggaagtactgtacagtgagtctaactagcattattactcagcgctcaagtatttgaacctattcagggatctgctccttcatacagttgcttattatttgtgactggggtgagacttgaaagagagcatcaattctccagtctgcttttgtttaacaggcagttccatgtctgtctgaccacagaacagacactgtttgctgtgggctggtgaatgttcactttcaagagcagggagtagatggcccttcgtggaagtttaattatacagaagagtttgaaaaggccaagtttgttactttggggcatggggaaaccttcctctctagcagatgtgaggggaccgaagtgtctcttttcagcagttgtattcttcttgctgtggacctaaattcgatcctaagtcattctttgtatgtacatggcagatgagaagatgaactatagactggaaaataacccttttttgaggaattgtggagaaaatgttacccacctgtccctcctaccaccatgcaataagtgtgggctacttaatactcttgaagcaagagtttaggtttggagagaaactgctcctctgatcttctcctggaaaccacaagtggaagtttgtgattttcttctcagctgccctgtcccctctcccttgggttatgacaggccgtgtaactttatctttcttaggacttatctctttgatgaggtcagtaatcctgcttcacttacgtcccctatacgtaagattgccataaccaaagatgacatgcagactctaaagcatttcctggaaaaaatgagctacagatagaagtaaggctcgtaatttaaaaaatcgaaccccagagaacagcctgtctctgaagttaaccattcccccagtactttctcttgtttccctggtgaaagtgtgaatctgggttgtggcaggggaagttctggcactgctaagaggtgaggaaggaagagggagggcccagagctgcccacctcacttgcaggtgtggcctggaagagtgccggggtctctaatgaagaatcaagttcaagggatgaagaggagttggcgaaggggcacaaaaatacagctagatagaaggaatgtgttatagtattcattagtataatagggaaattagagttaacaatttattgtgtatttcaaaataactagaagaattgtactgttcctaacacaaaagaaaaatgtttgaggcaatagatatgccagctaccctgatctgatcattacacatctgcacagatatcaaaatgtcacatgtacccccaaaatatgtacaactattatatatcaacaaaaaaaatcaaagagacaatttagaataagtatggtctcaagcctagtgactaatatgtggacaagtagatctgcactagggtatacaggaggaagtattatggagacttcataaaaagggagatggggcggggcgtggtggctcacgcctgtaatcccagcactttgggaggccgaggcgggtgaatcacctgaggtcaggagttcaagaccagcctggccaacatggtgaaaccctgtctctactacaaaaattagccgggtgtggtggtaggtgcctgtaatcccagctactcgggaggctgaggcaggagaatctcttgaacctggaaggtggaggttgcagtcagctgaggttgtgccactacactccagcctgggcgacagagtgagactctgtctcaaaaaaaaaaaaaaaaaagggagatgggggacatggtgggaatttgctaagctcttttgttaactgctttaaagaactcagactagggaaggaaacttctctcaagtttattgctggttgttatttccagaccatttgtctttcccaaactgcccttggccatcaaatcagactcctgctagagtaagcctcatggtagtgtctcttggctcacctctgtggttttgctaattattttcatgtattgacctgggatcacagaccaggcacccaaagggacagaggtgagttctttttctttgggcctctttggatactcataacccaagtccctgtgacaggttttggaaaaatggcacatctgaaggattggatccgtggtgcattttgtaattgctgtatcctcttttctttaaggtcttgctgtgtcacccatgctgaactacagtggcgtgatcatagctcaccgtaacctcaaagtcctgggctcaagtgatcctcctgcctcagcctctggagtagctaggactacaggtgcaccaccttgcctggctacttttttaaaaaactttttgtggagacgaggtcttgctttgttgcccaggttgctctcagaactcctgggctcaagtgatcctcccacctcggcctcccaaactgctaggattataggcatgaaccactgtgcccagccattttgtcctcattttgacttgagatctgggagattttaaagatccgtgtcatgagttcacttgactggtgctttgcacttttgagacccgtcactctcctgactaataggtcttgacggccactaatggccagcaatggctgggaacagcaggacactctcactttgtaccttttgatctggtctttattcaaagtggggtgaacccagtaggagagttgttgttttggggataaagtctgggtgacagattcttcaggctgggtaagtctcctgttctccccgactttgagacctgaatgacctgatttggctgactacacctccagtcccctggacaacagccagctcctttgattttgtgccatttagtccttcccttcatctgctgacgctgatactttcgggtgaggtggaaggagagagcatacctgttggtgaggtaagagtgttttccttcagagaaccaaagaaacaaaggctccctttctgaattttgtgttctgcctctttgcatttctgaggctccttgtgtctggcagggctgtgagtgaggagatgagggtgtgctcctctgcaggcagaagtcagctgtaggtcagatgtggctttggaacacaatggaatccagggggaatgttggcgagcacagcaaggctggggtgatgatcctctaatcttttgcagcgtgctgtaagagtatctttaactttcgccgagacaggcagggcaatgagcaaaaggacctcggtgttaggtaacatctcaagtagggcacctggtagtacacctgtcttgcatgttcccacccttcccaacactttatctttttgaagccatctacccttagaaaatgaacaaggagccactgacatagacagcaagtatatttacttatcttttgggtgcaaggcagtttgccctgctgggagagatgtgggataaggccccagagtggaaaaaaacaaaaaaccttaaaaatgcaagaaggaagaaaggtaggtgagccagcaggtcccactgaaaggccttgttattgcagcaaagagggaagaggtgggcccagtggcacaaatcactaacattcttctgacagtcactagccagttcttctgagaatttctctgtcttgaaaaacttggtaaaatggccaaatggagcttctccgaactagggggaatgcctgtgtgtgcgttcgttgttagccatcatgttgaacagtctgatttaagggaaagttggtctgtgtacattttcatttcagctgtggtctttgaaggttcaccatggaggaggtgtgggtggatgagaatagagtcttctgcctcttggttggcttatatgtaggttataggtgaatgtgagttcacaacccccagcctatttcttatttgggtgcacttttggatgacttgcagggctgagtttgggaaaacccagttactcttcctttatgcacatatttctgccagactaaatgccaaatagataattggaaagaattttcttcgcagccctggtccccaaattggtgtctgtgattcttcctagggtctcatattatgagagtgcactccctttaatcttttgggacctcaagtggggtctgtgtggacaagattgtgcttctttgagaaacttcttgctgcacaccagccagggtaaggcaagagttagtcctgttggctgggtggttcttgggcagttgagcatgcttagcacttgagaggtttctgttataccatttgccaaaagggacatctctccgctggtcctagtgccccagggcacaaatggcaggctttaggagaaaatgcacaatttcaggttcagtctctatctgcatttgtgtgcatgaatggactaataattgcagtgcgttgaacgatttctgcatattccaacacctagaaagtagcttcctggattagggaacggttcctaggtacagctaccaaaggctcaagcttaagcaccaacactggaggttagaattagcacgctctagggaggacagcgagagggcagctgacacaatgcctttatgggctatttttagctttagtcaggcctatctggagtggcttgtgctttcttgggcaccgtcctgcatttattccagggtttgtgcttgtgactctgtttgcatatatgccacatgtatcgcatgctcatgggatgataaattgcagaaattatggcataatctgttttctagcatatagaggaaaagattacacaaaatccagccttgttgtggcgaagaaacctaacatatagatgtaaaatatatctccttggaggcctggctttgtgatgggctatgaacggattgttaaacagcaatgtgaggggctgttagcaagctgtttctaagagcatctccctggtctggtctgaaaaggtgatgtgtacatattgtacatttgagatagtttgcctgtggtgtttatatgttggtaggttgtgtgtgtgtgtgtatgtgtgtgtgtgtgtgtcttgtctgtcttcagtggtgaactgaaaaaataaagtgttgtttacgtgcttctatgttagtgtctacattccaaactgggcaatagttttctttaagctggcttaagtgaagaggtgtttggtcagccacagggtatgaatcaaccaaacttcaaaaagcttcagtgtgtttttgataacactcttaagtatttaatagctgctttaaggatttgtgccttagtgtacttggatgaataggtaaatcacctccccatcagcaaactagcgtttgggttcccacgttggcaaagcagggttcctgttatgtgtctggtcatatttgaacttcttttcacattcaggtgacatagttgaacatcagtccgtgccagtttctgctactattgggtttttaatggaagagaactctttcttgttactacgatgccatgcttctgctgtgttagcagctgctgtattgaaaaacaggtgtctcttataatcctctgactggatcagtttgctagcctggcagagtcttattgttattgtttttatttatttatttttgtcccacataagtcagaaactgccaagagatgttgatgagtgggattagtatgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcctccataccggctgtcactgccttccttctggccccagacctttcagttgtctcctctctgatcttccttcctccattttgtccccacccccaacacaacttggaatgattctttgcagataaaaatgtgatcttgttactctctgtctcacaccacagtaccacagtgtagcatgaaccacagcttcttgtcacctgcaaggccctttactgcctacctttctagtatcatctccacattatgttccaaccacataatgaacttttttctcaggaggacatggtctcgctctgtggccaaggctagagtaatctcagctcactgcaaccactgccttctgggctcaggtgattctcccatctcagcctcccgagtagctgacaccacaggcacgtaccaccacactaggctaatttttgtatttttagtagagacagggtttcaccaggctggtctcaaactcctgggctcaagtgatccgcccaactcggcctcccaaagtgctgggattataggcatgagccactatgcccatcccatgtaacaaacatttatgcctggaatcttccctcgatcttctttctgcctggcagccaatttgtcattggaagtccatttctcaagcctccctgttgctgctgggcacagtgttcccccagcttattgaacttgcttctgttattggcaacaatccagttatccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgagggttgaggaaagaagaaaggtagagacctgtgttttgaaacatatcaggactccatgtcagggcgaacatactgccacctcccatacctaaggggctcctgtgaggcataagtactgacatgtacacacagggcactcacaaatgctctccttctcagttgcctactttctagaggggaatatagatagctggagaagaagcttgagaaccttcaggctggatgtgccagaaacagcagagacagcccaagataaatgaatgtattaactgatcatccttttttttgatgtggctcaggatgcctcttgggtcagggagagagaaccagtggctgtttgttgtagctgtgtgcggtcttggccatagctggctgtggtatctgggacccagtggcaggtcaccaccgtatggggctgccagttgctcccccaccccattcctctaagagctagtagggagagagaacccggaagagcagcacggcttgctgaaacttctctgaggtctgtgattggcctttccatgtcaagggaagaatccctctcttacttgagtcagctctttccagtcttctcttgtacagcccatgttctctcctaccctatctgagatgaagatctctctggagctctcattttactcctaatgggttgcctggagggactaaaccagtgagaatgactgggcatactatgggactagaaaaacaactcaaagttatgtcttacggatggtaggacagcctcaatattgctgtttacagtggatagcccagtgacatttatttaaagagggcagtcttaagagagtgtgttagggttatgaatctgattaagtgtgatctgataagtgggaaatggaccacttgggagaaatcaggttactttcagatataagcagaccaaactgggccttccacacaagcctgaatagctcgttttctccctatttctgttgccattgaggtacagctgggattcagggcattaggatatgtgaaaacttttagcttcctgaacccaaccagaccccagcaagagtccttttacagtttccccgaaaccgtcacaagttttcctgaccgcctgctgggggctttctgttgcagacctacgcggcagctgcctgccagccctgccagatttgacttcatcttggctgccggtgggtcagtctccacgaggcttctcttggcctgtctgtccactcagggcatttaagggtcctcttgctttgctcacatgggctcctcgagggcttgtgcagtaggttgagagttgttacgggtgctgatctggaccacttagggagcagaaagcataggtctgtatatgaatgtgaaaatacacatttaagaagctgctcaggtaggggcagccacggaagttgtgctccctcttaaacactcagcgtacacacctcatcctcagacaatgtgctgcttacatttccagtgtccagcacggtgcctggcacagaggaaggccgatggatagtagttgaacagaatttttttaatcatcaggtctttattaagcttctattatggacttcaagtttcctccatgaatgctaccagaacccttgctcaatgtcttcactgttgaggctgttgagtgagaagccatttccttccccttctacttcccctccctttacagccttaccaggcccagtgttcagaggactcgatgctcatgaacctagggttcctaagaattagcatgtcacaatctaatctggagactatccgccatttagttccatggcggattatggtcttggttctagcaacctgctgaagaacaaacctggtggtttattttcttttttttttttttaaatggggacttgccttgtctcccaggcttgagtacggtggcatgatcatagctcactgcctcgacctcctgggctccagcgatcctcccacctcagcttcccaagtagctgaggctacaggtgtgtgccacgatacctggctaattttttttttttttttttttttttgagatggagtctcactcggccgcccaggctggagtgtagtggcatggtctcggcttactgcagcctccgcctcccaggctcaagcagttccttgcctcggcctcccgtgtagctgggattacaggtgcacgctgccacgcccagctaaattttgtatttttagcagagacagagtttcaccatcttggccaggctggtcttgaactcctgacctcgcgatccacccgcttcggcctcccaaagtgctgggattacagccgtgagccaccacgcccagccaatttttaaattttttgtggagacaaggtctcactatgttgcctggctggtcttgaactcctggactcaagtgatcctccagcctcagcctcccaaattgctgggatcacaggtgtgaaccgccacacccagctgagaacagacttttgaactaccacaactataggtctgttggacattgttttcagttgaaattgcttaaaaattgacctgccttggagaaaatttcatgagccttttcttaaagagtgattgaaatgccaataagaatgcaataacaagtgccctgtgtagatgtgtgggagggacaccctccccttcctccacccagcaaaagctaacgtactttccaaattctaaattgtgatgtgtgacttggtaaaggacttcgcactgttttgttttttttttttaaattgatgtggcaagccttacaaaaggatatgccgttatattctaacaaattatttctatcgaaaagagtatcatgtgagattagggctgtagaggaacagcctttcaactagtcttctatgtggtaaaggtggcacccagtttccaaagacagcacagacgccaagggtcttttctgaacttcttcgatttttatgatccctggctgggtcggagaagggctagttagtatgtttttctttcttctggatgaaagttgcaaggacacttaagccttatgcttcagggcggaatctgatcacaagttgagatcaggaagaaattttccccctgtggcttcctattgcacaattgcccggccaggtgtgctacctctgttaaacaaagacacacacaagtgcacacctccttactggctatcttcagagcaggatgttggacgttgtgggccagcagactggttcctttggcacatccctgtgctcaaagatgggaggcagctgcccgtctgctcctgtacttggctgtcctctgggtgtgctgtactgagctcagggccacgtcttcagatccctacaactctttgcaactcttactttgtgggacaattaaaattaggtctaattctgtacacacccgcatgcacatgcacacatatctttttaaaagttttccttaaacttgcttcccctttcctgggctttgcttcccccttcccgggctttacaccacatcaaacctatatgcattcccaaaacatcaaaatgactgttcacaaatcatagtagaactctttaaccataaggtgcgcagttgccaatctcaagcttggattgtaagcgacttcgaagtctgatccaaaagactgtgggaggagggggaaggaacatggatggacttctttccttcctccctccctccctcctttcctcccgtcctcctgtcctcccttcctcccttcctccctccctccctccctcctttcctcctttcctcccttcctccttcctttcttcctttcttccctttcttttctctcttttctttctttcctttcttctttttgaggcctcggctgtgctgcctcttgtgcaataggataattaccagcgattcccaggctcgcctgcttttctgcctttacatctctatctcctgtggcgcagtacttccttctgcctctattattagcttacttagctttaccattcagttctccacctcctccccgggtccctccccatcttcttccagcctttctttcccttcacctctgtaaaggtattttggggagctaccattcatgttctgttcatacaggaaccctctttttctttattaatataaaataatcttggtcctgcctcattttatcatatattcattcgtattcccaaaatagaaaccgtcgccaccagcacgtaatgtctggcctgtaaacctttaaagtaggatgtgccgaaatgagatcttcacaagcaggtgtgcctcatcccctgacctgcaggcccttcttccccggcggccattcactcatcttcacaccatcttcttgcccttctctctgcttttcgatgattctaccccaatcacattccttcccaaaatgactgtgttagtacttaattgttcacctgggcttgttcatgttgtagttcatcgtttcctttttatctttaaaattttcttgttcttcggggatacactgtattcttgtaattagagattatatcagttttcatggccaaaatttgccacgtggacataatagtatttggtatcaagcacgcctttcaggaagaagggaaaaacagtagattttgggcagcttttgattacaataatttcaaatttctaataactaagaagtacttcatgtgattcttgtagagtaaaagcttaaaaattacccttttctttgtaagtgatatgagtcttacttcgtttgggtaagaaactcagtttgaggctaccaatttttcaaatagtggtcttagaaactaattattgctgtaatttcaataactaaataggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggatcagttttaagaccaggtcagacatacgtacaaattctttctttgtaaatgagaagtggcctttaatagctttcatatggatagatgggtagatgaaatattattctacctaaagcatgacatttcagtaagtactacactttgaaacttgccttgcagggttttaaaaatattcttttctgggttctaatcatttataacgaagagtcactagcattttattaaaacccatattttttggagagggatattaagtgagcagggattgtgggttgttcttgcttttccttaactgtcctgccccaaaaaagtgatgggaataacccaaaccttaaaggttcctggggctttctttttccctagacagggacctcctcctctcccctgctctcatcccacttgttcctgaaaaagggtaaggttggcagggcggggaagagagaaggaaattagggttctagcttaaaactgctgctagagtggctagttctgggagctttttgagagaggcccaaggtggcagccttgtctcttttgcctctttcattaaacctggggtttgctgtacaatgctttgggtctcctgtcccaaaaataaagggctgtggcaagtatcatcctgacaactatccaatcagttctgactgagaggcacttgtaattcagaagatagtcattagatttggatagaaagaaatgagatgtgatgttcagtagatcagtagggtgactatagttcatgttaatcgattgtacattttaaaattgcttaaggagaataatttgaatgtttctagtataaaggaaagagaaatatttaaggcgatggatataccagttaacttgatttgattataaatgtatcaaatcattacatgtaccctgaaaatatgtacatctaatatgtatcaataaaaataaataaattcattagaataacagaatttagacatttagagctatagttttaaggaatttcagaccaaggcccaaagctcggttaagtgacctactgaaggtcccaaggctattattgccatattagaactagaagtcagatctcctgactcccaccagtgtatattgacttttgacccagcagttagttttattttaggctgtattttcgaaataacagattggttcaagtcaaaataatcttattcgtgtgaaaaactcaaccaggtgaactgagtgaatgaacctactttttaattgggtgtttttaggtcatgtgaaaaaaaaaaacacaaatcagaaggtcctttgtgcttcatgtttggatctgatccttttttttttttttaagctgaaaatgaatgaaggatggtagagtaggaactaggatgtacgcataaaacacttgcctgtctgccttgtcacctgcactccagtggggtgtttccagggctcattgtaaggtgagaggtgacttctggacccttgactaccctgttccttctgtcgcaaaatataatcaggaggtttctatttgacaatgtactctgagtattgtaaggaaccaactcccaacccaaatcgaatcgcctctgagatcctattaaacagaaaatgccctgaacaccagtatatgaaaatgctttgctaggatgagctcaaagcatttcatcctccaaataaaatctatctgctcacacttagattgttcaaaggcagatggtaggcaattgaaacagagagacaagctggcaaaaggaaaaataaaaccacaaatatctgcacgtgaaggtgatttacgctcttgccagcccccctcctaacttcgttaacacaacgacgtagcaattaagtagcatgggaactcgggctcagatggctgatacagttgtcctccgttaatggggtgagacaaagcttgcgtataatatacagtgctcttcaccaaaatgcagagctaaaagagattttaagagataatcagcaacatagcctgtaaatcatgctgctcataacagacggccaccttactgaaatctcactgacccccaccacacgtgttaacagcagggccactgctctgaaatattagctattaccgagtggccaagtcttaagaaagggaccacttggcagtattgaacttcaaagtggaagtaagatccccttggggtgagggtaggaaggcggtgaacagggttgatcagaaccgtggaagagtccggagcagatgctctgtgggaaaccctgaattagccaagagcaaaagttatcgccatcctactgctctgggaaggctgcctgttggagaaaacctctgtgttcccttagccttttcactgactggaggactttccagacgaaatctggcacttctcagtaaccttgaacttgaacattcagtgacagaagggaaagggagagggtttcagctgctggagctgggtaactgtgcagggctctcgcagcgggccatttgtggctctgagggtgccaagctgcagtgttctgagggtgtgtgaatgagggtgttgatcctggctgcagaaggggcagctttctgagcaggtgggagtggtgaatgaggaggggatttggcggggcaggatgtgagatgagtttactctgctgggaaagaatttggagatgtccatgaagaagaaaatctggatgactattgagggagggctgatgttggagagaagggctcatactacaaatcagaataaaataaaggatatcttagtatcaagaggaaagcactgttaagatactaaaccttctgctgcccaggtatctgaggagagaccatggaagagttctatatggaacaaatgaaaaagcagtaaagtcaggtctagacctggagtttttagtaataccaagtttacataggaagtgtctgggaagtagtgattagagggaaagtatgttggatgagtgaatcattccttcagaaatcaatattttttcctactaggccctccgaatgtcatctttgtagttgcccaaatacatcagtttctctcttatgtaagagagcttgtctcatttttattgctgtattccattttcaagtgtcttcttgggtaatgatcctgtatttgatcttggccagatattatctgtgactgttgttagagtgatccttttcctttcccccgagttagtcaaactgtgtgcgtggtctctagactgagatttggcagtgattccatggctcttgtgagtggagttgactaacaaaactcaggaatggaatggccatattttggaatttggttgaagcaagtaaagtttttattcttctaccaatgcaaatctatctcagggaatttctctttattcagaaagaatgacctccatcccacctttctctaaaaggtacaaatcgtaatgcatatttgacacattagttggcttttaccttggggaccagcagaccaccccgcagatacaatgcacggaatctagcaaacaataaagagcagtgtgctcgcgtggccagatcgttcgcttccttcctttttcgccttcatttttgggaagtccttgcctcgttagttccataggccatgagacatagcaatataaaatgccagaggatgttcaaatgggcgtgtggaggaagagggaaagcaggaattctgggccaaagagcagatggccagccagtgacctaggaagggaagctcaggcttttaaacaatggcaatgtttcttttatgtgcagttttcattaaggagtaccgagactccaagttggaggattctgaaagtggtcatagagtccctgccctcgagatttaatatccaaagaggagacagtggttttaatataatgaatatatgcagaaaacagccggagacaatagaaacactttggcaccttctgtggcgctgctaaaatgtgtgctgtagctcaaggcccataggggttaatgtaggggttatttgtgtgtgtgtgtgtgtgtgtgtgtgtgtgtgtgtgtgtgtgtgtgtttggtgttttccccatgaagccctgattgtgcgaccctgggtgagccagctgcttccgctgttttccaggaaagcatgagtgtccaccacctagagagatgatgatgtgagaaggggcagggagagacctctctggctgccactctctcactgccccaggagcggaggcccctggtgctcaggagttctttggctgtgtccggatccaccaattccccgcttccctaaggatgacgggtaaatctggtgagacccgctgccctcctaatgttggaggaaagctggagcccctcagtcaacatttatggaagggatttaatgcatcatgggctgtgaaggtacagccaggccctccgtcagctccctgagacaggccttgtctttttgcacgcatatgtctgttaatagttgtagacctagctgtagccatgggggtaagcctagtcctccagcccctgagagtttattaccacaaggagtgagaacaccaggatgtgtttttttagatgttcttctgtaacccccaagcacctgtagctcccaggtgtttttacattgatctcagaattacccagaaaacattctttgaagaccttgtagagtctgccatttgtacttctgctacaaagagcaaaaataaagcaaataaacaaaaagcccctggaaatcctatagttatcctaatacatattttaaagtattacctatcactgagcaagtgcatctatacatttcaatccttttggaaaatatactttctcaaacttcatgttgtatccctctaaagttagttagcacatattgtacattcagaagaaatgttcatttacagcaaggcataggttttttttcctctaaaagaaatttgaccaggtatggtggctcatgcttatattctcaacattttaggaggccaaggcaggaggatcacttgaagccaggagttctagactatcctgagcaacaaagtgagaccctgtctctataaaaaaataaaataaattagctggatgtggtaatgtgtgcctgtagtcccagttacccaggaggctggggcagtaggatcccctgagtctaggagtttgaggctgcagtgagctatgatcatgccactgtacttcacgctgggcaacagagtgagacctctgtctctaaacaaaaaggaaggaaggaaagagggaagaaaggaagggaagagagagagaaggaaaggaagggagagggagaaggagggaaaagaaaaagggagagaaattgatgcaggaagaagaaagaaagaaaataaaagaaagggaaagaaactgatgaaggaggaactgggtacctagaagtggttgaatgaaataatcctgtaaagtcatctaaggttcccatctcattccttgccttttatttcttgccatcacctatggccacttcttgcttgttcatgtcactttctttgtcagtttggaatgggccctgcctggctgatggctttggagaggacagcagacagtcattagagactagaagctgccaagcgaggcaacgtgacagagcacacagctttatgcctttttcttagtctactctcagcttggaaatgtaggagttatagtgacacagctcagtcagcctcttcctcccccgatcctggatcatccactctgcctctccctcccccagtcccagatcatcctgttttcctagaccattccttgccctgacaaatttctattactctcaggttaaagcccaactaaccctgaccaggctgcaaggccctgcgtgatctggccctgtcccttgctctttgtcttggactgcccttgcccacaccaactccttagcattctacagaggtgccatcctcttctctcctggcctttgcccatgccactccctgaaacactccttctatctctcttatcccagctgatggctctttcctaggtcttatctccctggggtcttttcttgaactcctcaaatctggatgagatgtccctcatatgtgccctcatgacatccgttttgaaacttctatcacatcaccttgtttgtatgcatcatttgtcaataagcccacgagatcagagcccatcttggttttgagcttatgaacatagtgttgggagtaggtttggtgctccataaatatctgttgattgaaggagtgcgtggaaaacagaatttggtctttgatttttttctgtgtttggctcagtgtctgatgctctcccgagcattcttatcagtccacaggattttgcaggactattagcagagggtaatgcatatctgcaatattgtcagacatcgcctgttgttagacgtttgcttatgcagggaaaacaatatggagtttttaatttttagttggaaattcagaatattaagttacacataacctgcagtggtttggtttttaaattgagtttctgcttgttgttaaacccaatccgaatcaactaaagggaggtctattctctctacaaggacactgtggctctctggatattcctgtaagacaggaaaaacgatcacagatcaattctagttgctgcctctgagaaagaagaacaagatagatgggtctggctttgtgaggaacctttctctctctcctccctcctcctgcctctctctctgccaataattacaaagctgaactgaactgctactgagaatccaagttctttcctggctctgactaagagaacatagatagcatatgcatctagattctttggctgtatacggacatatatacatgcacacacatacactctgtctttggcctgaaatgacggcactgcactaagacctgttgtttgtttcttaagcagatggatggctagatttttctttatatgaatctttcatgattacttttactaggacagagctaaaagaacatgggatgtgaagtccagtgagttggattgattggatgtatgcgtattgagcacctgttacatgctggacattatcagaattatccgggtgaagaagatgaggcctctgattgaagtggcttgctgtgtaatgtggttacactagtgccacttactctataactttggcggacaaattactggacctctttaaacttcccattgcttaaccgtaaaatgaggatagtagcacctactttatagtgtttccaagagcatctaccatgataatgtttgtaaaattcacttgacatacacctgctcatccttgacatctcccagtgcagtcaccggagcgcctcccagcgtcctctggcacaggtaggtgcttcccctcgtgcagttctctgcttggacacttcactccgtgctgtcagcaccctttgcttctgttcctgcacttgtgccaaaccctttggatgaagagcctcgttgtgcccatctctggattcctagtgccaagcatggggtccagcacttgacacatggctgttgctgaataaattaaagaacaaggattatggatggccaggtaccatgcatataacatccttattataagaactttgggccagaaaacagaacaaaaagggagagtgctttgaggccctggagatcagagcaaatctcggcaatatcacgctccaatttgaaggctgtaagtgtgtgctgctttttagcatggatgctgatcaactgcccgaggtaaaggaacctcttgaggtcaggaaggaggtctgtatgtttagtctggaggtcagtctacattttggttagctaacaaaactaacagacctaggtggttggcaattagaggcgcattttgattgttttatgccatatactctacaactcacatggcagcacttttttcctcctgatttcctttccctttgcaggaagaaatgtgtttctccttttcttggaatctccttattttctgctccgattatatcccttttttctgctgttcatacaatttcaagaattaatatgagttatgagggttctccagagaaacagaaccacaaggagataatgtatttatttattatgagaaattggctcacgtgattatggagactgagaagtcccatgatctgccatctgcaagttggagacccaggaaagccactggtgtcattcaatcagagtccaaaggcctgagaaccaggggaattgatggtataaatatatcccagtttggggattggagaagatgagatgagatgtcccaatgtaagctgtgaggcaggggaaaaaaagggagtgactggtgaattcttccttcctctgcgtcttgttcttgttctgttcaggcccataatggattagatagtgcccacccacattggggagggagactgctttactgttcaggagctaatctctccggaaacaccctcctagacacacccagaaataatgtgtaatctgggcaccccataatccgagtcaaattgacatataaaattaaccatcacagatattaatgtcattgaggttgaaaggagagtgttcttgtccttagtgtgtgtttgtgtaaatacaatttctaacacaatctgagtgtgcaggaaataaggaataagcactttaggggaaaagatcatgtctcaaaggatcatttttttttctttacccacccctttgactctcagcattgaaatcaaagtaaggccctgagcagctatatagtagaagaaagaaagaaaaaagtaagaccagatggttgtttggaaagaaacagccactcttagcagttatgcacagcataggtagagtaagttcttagtgctcgataaatgaatcaatggttgcactttttagaaagaccatttcttcttcggtaaagcttgctagttcttctcacagattctcttttcatccgttccataggttctgcacactggtgaagggtaggaacagagtgatcttttctttccttcttgctgggtttgccacaaagcatgttgaatggtcttgatgtttctccggtctataaataaatacttttttaaatggagccatcatgggatctgactctatttattcttgtcactctcttctctcctcccacagggaaatggcacatttaggaagagtttccattatttgtaacatttgatgatttgtgtctttcatagaccatgtatcagaggtggagaaacagcttcttaactttcagacttgcttgttcttgactccatgagccatctaggagagttaccccatttctgtaggcatccatcagtattcatcctctgtgttcacacgctttctcattatattactcttctcaagtttacaaatctcttctcattgatttcattttagtttggcatcatggtctagtgagactaacacttggctgggaattgggactaactgtgtccttggataagactcttaccattctgggcttgtagtttttctctgtaaaagttgagacatccagcttgatagttctctggctataagggcattttgacctccgaatactgaaaggatgcaggtaggggttgcaatctttcatgctctgtactttgcaagagtaatttggtcagctatctgaggcattcccatgagaaccaaatggaactactctggccccttcagatagaaactgttagaaataaaaagcttacacttgttggggggcaggcagtatattttacatctgctgataatatgctagaaccaaattgcaaagtgtacccatgtatgttatttagtattttcattgttcacatttttctcatttctaaactatgttgaatagtggaatattttgcttcctttggttttgtttgagaacctcttctccccttagtgatggtgctgtagctgtcgtcagcccaaaaggtccatactacatgttcagctaggacagggaccacatcagggcaggcatctcatataatttgactcagccctaatacactgattttcttacagccaaggattaactctctccattaaagactcatgtgaggggaagaacagatagcaaagtgtttgctaaaatgatgaactgtccctatttcaccttcaggcagcaaaatcatctgcttagaaactaattagagcattttccccaggcgttggtgatctacttctacatgcctatgatctcttagacagtagttgtaccatgttcaggaactggccataaagcagccctctccctagcctgtctccctctaatagaagaaggctgagagtggctcattccttcagatgaatctcagaccttttatttcagattcatttaagggcatttacttctctgtgatgctccttactttctgttctttaaaatcttctttgcttttggatcccagggtagacaaggaaaatgttgcaccatcatatataggtaggtaggagactttaaggtgctcaaagcctggtcgacattttctggtggcacagatgaagccattttctatggaagcctcctaggcaagactctgtcctgcatcccactgagtatagacctaatttctttctaatatggatggaggaataagcatggtcatttatcatgctgaggcagctgtaagccgtctgcatccgggttccattgcaattggaacagtagcaaatccattgggtttctttgtttttcagggtaattttctttcccttacagtgtactacagatttggggtctgtggtcttaagtgaacatttacataaagttagctatttatgattttaaacaaatttcatgcccctttctgctgtgttgttggtatttttggtttctatgtatcataaaccacagaagttcagtgacttccatggaatgatgtggaaaatcaggaagtaagactgaaattaagaatgaaaatttctgactatatgtgtcatgctcattttcaccgtttaaggtctttcagaccacaatttagtgaataaatctatatagcaaattttttaaattctcacgttttatttattattattattatcatttattattatactttaagttctgggatacatgtgcagaatgtgcaggtttgttacataggtatacacgtgccatggtagtttgctgcacccatcagcccgtcatctacattaggtatttctccttatgctatttctctcctagcccccacccactgacaggccccagtgtgtgatgttcccctccgtgtccatgtgttctcatgttcaactcccatttatgagtgagaacatgcagtgttaggctttctgttcctgtgttagtttgctgagaatgatggtttccagcttcaaccatgttcctgcaaaggacatgagctcatccttttttatggctgcatagtattccgtggtatatatgtgccatattttctttatccagtctatcattgatgaacatttgggttggttccaagtctttgctattgtgaacagtgtcacaataaacatacgtgtgcatgtgtctttatagtagaatgatttattaccctttgggtatatacctagtaatgggattgctgggtcaaatggtatttctggttctagatccttgaggaatcgccgcactgtccacaatggttgaactaatttacactcccaccaacagtgtaaaagcattcctatttctccacatcctctccagcatcttttgtttcctgactttttaatgatcgccattctaactggtgtgagatggtatctcattgtggttttgatttgcatttctgtaatgaccagtgatgatgagctttttttcgtatgtttgttgaccgcataaatgtcttcttttgagaagtgtctgttcatatcctttgcctacttttagatggggttgttttttccttgtaaatttgttttaagttccttctagattctggatattagccctttgtcagatggatagattgcaaaaattttctcctgctctgtaggttgtctgctcactctaatgatagtttcttttgctgagcagaagctctttagtttaattagatcccatttgtcaattttggcttttgttgccatgcttttggagttttagtcataaagtctttgcccatgcctatgacctgaatggtattgcctaggttttcttcaagggtttttatggttttataggtttttatggacctaaaaccataaaaagtctttaatccatcttgagttaatttttgtataaggtgtaaggaaggggtttcagttttctgcatatggctagccagttttcccaacacaacttattaaatagggaatcctttccccattgcttgtttttgtcaggtttgtcaaagatcagatggttctagtcgtgtggtgttatttctgaggcctctgttctgttcattgttctatatatcagttttggtaccagtaccatgcttatacagcatatttttgtttgcactttcattgtgaatgctaattgtttttacttaaagattcctccttgagtagattcaataattcaaactggacatgaacatgtgactttttgagatggaatcgctctctcgcccaggcttgaatgcagtggattgatctctgctcactacacccaggttcaagcaattctcttgcctcagcctcccaaatagtggggattacaggcgcgctccaccatgcctggctgatttttgtatttttagtagagacggggttttgccatgttggccaggctggtcttgatcccctgacctcaagtgatccgccagccttggcctttcaaagtgctgggattacaggcatgagctactgagccaggccatgtttgaatttttacaagactaatttaatttcacatttcataggtaacacatagacttagccacatttttcatattggtgcctccatggtagataagacattgaaactataatgcaactaagatcaaattttttaaatgtcagaataactttaataaataaatttgctcatccttttttgatggaccctaacaatgatcagtttttagccatgatgttatctgccactagactgtattattttctcatttaacatagcttcatggtactaggaatggaaggaggaaagggggcatgaacttctcaagactgctttgtaagtctatttctttctttgattcccatacctcaaggaactgagagcaaactttgagcctgagtgtaaagtttgttttcctggaaatgtcaccaggctgtaaactcagaaacagattgcccccaaaaaattccctaaagggctctttacttttttcttgtgttacctttttttcctgtggcattctgtctcataatatgaacctcatatagttgcctcccaaacttttctgtttagcttttttttttctctccaagaggaatttctttaagtacactatggaaatgtgcataaagatgaaagcctgacttttctaaacactgtgttataaaattaattgacaattaattcaacagatgtgtattgccacatggatagagggtaaaggtagtcatttgtcactgacttcgacaactgagaaaaaagtgattcaagggagttggccctgcatgtaaggaatttcaggaacaatgtggtcaattaattttacttaagatgaatgtaaacatcatgtgtacatgcagttctttcaataaatacaaaataattgtaaatgataaagtggcagataaatcttagtggcagataaaccagtgcctctaacaatccgcttctgccctgtggcattttttgaaatgttactaatttgacagactaaatgagcatccagtattatttagcttttaaaacatattatttgtgtttttttcctttaatattttgcttagaaagtctttctctactctaaggtcaaataaatgttcagttaaatagatggaatattacctgtttcatttttacattcaggccttaagattttattagagaaacttccacacatattcagaagtgatgagaacagtataatgaattatatgtactcatcactcggcttcaacagtgatcactacgtgactaatcttgttttatctgtatgcttacatccttctcacccttccccttccctattattttgaagtactagtcactcagaatttcagctataaatacttcaggttgtgtctttaacagacttaaaaaccaagcaagcaaaatgtcattattacacctaataaagctaacggtcatgttttcatattatctaattaatacctagagttcaaataaaatgcctagtatttttggggctgaagatacaacccataaaagtaaagccttggtgttataatacccaagagccaatattctaacgtgaggaaacagacaaaatgtaagtaaaatacgaacaagataatttctgctaacaatcagtgctcggaaagaaacacagtagatgacagagagagtgacgcagggccagggggatcctattccaggtcggtggtcagggaaggcctaggaggtggcatgagtgtgaggaccaggtgaagggcaggagctggcccaggggacagtgtcctaagtggagggatttgccactgcgtgaagagcttgatgggcctgcggagtgtcatctagctaggcacctttttccctgttaatgctggctttagttatagtcatttgtaatgtgtagattttcagtgtcttaacttttcaacagggtaaataggaccatccggagtacaccaatattgagctttgtgataccttttggtcgatttgttgatcagttatgcttcattgtccatgaacatttcagaaaaaaaaaaaaaaaggaaaaaaagaaatggaaaattcaggctacttaaatcacgcctttgaaacctagaaacccttaggggcacagacccttcttgtgtaataacagagctctattttctgctgggaagttccctattgagatttgggacacttcctaattttttctgggtaaaataaaagtgacaacttttttttctaatgactttttaatacttcttcttatctgagtaaaaaccaggaagtgggaagcaaatgtacaaaaaccagcaatacacacacacgtgtgtgtgtattttcatgtacatatgaatgtgtatgtgggtgataggaagaagagaggatgcatagagaagatgatctcgatcaagtttgatgtaaatgtaatagcaaattagagtacattcttgtcttaatcttttctgtaataaagataaaatggggcattatgttcatatgattgaacaaaagtggatgatttcaacctttttcttctcagccattaaaagaagaatttgaaagaaacagtctttgcatacatatacagagagtttgtcagcctttcttcagacacagccagccacagtcagactaaacattcgaagacgttacatttagtccacagtggaagtatttgttgattcacatattttctttttacaagaaaatcttcagggttagtattcacccctgaattggacacaaagtaaaattccattgtgttataagacagcttaaaatatctttgatttaatccagaaaattctatcactcttactcctgaaaaaggtgctggtattttaggctttaccagtcagctacattaaaagctgtggatagttttgcaatttatgaaataattactcttcctcatttgtcttcttgatttgcccgacatcaatgctcttgtgttcaccagggactaatgattgtatttttcttcccagtgggtgggataggataccagtaggtgggatagagagtttatggtagattcagtttgtctttatttactcaagcactcttccagggcctggagctgtcaaaggtgaagtaggaaattactgtttacatctgtcgggaattcactgttctgtctttcatgagctttcatgccctttagagaccattttgcacaccttgattgtcagaaaagggtctgggatgtttttggagtggtacagagatgcatacagcaacttacactgtcatgactttttttttgagatgcagtctcgctctgttgcctaggctggagtgcagtggcgtgatcttggctcactgcaacctctgcctcccaggttcaagtcattctcctgcctcagcctcccgaatatatgggactacaggcatgtgccgccacacctggctgatttttgtatttttagtagagatggggtttcaccatttggccaggctggtctcgaacccctgacctcaagtgattggcctcccacagtgctggtattaacaggcgtgagccaccgcacctggccctgctatgactttcaatgctctgttgtagttttttcttaaaatttaagtttgcttggcaatacctttttttttctttcttttctattttagacagagtgtaactctcacccaggctggaatgcagtggcaaaatctcagcttactgcaatctccgccttccaggttcaagtgattctcctgcctctgcctcctgagtatctgggactacaggcgcacaccactgcacccagctgatttttgtatttttagtagagacggggtttcaccatgttggtgaggctggtctcaaaactcctgacctcaaatgatctgctagccttggctttccaaagtggtgggatttaaaggcatgagccactgccccccaccccaccgccccaccttttttctgttcttttttttttttttttcagctcactgcaacctccggctccccgctccccacgccccccaccaggttcaaacgattctcctgcttcagcctcccaagtagctgggattataggcacatgtcaccatgcccggctaatttttgtatttttagtaaaaacgaggtttcaccatgttggccaggctggtctcaaaactcctgaattcagatgatccacccgcgtcggcctcccaaagtgccgacattacaggcgtgacccgcacccagcgccacaccccctttttttcttaataagaaaatgagtagacacatccctgggtgccaatcactcatgtatcaagattgctgagtatgagaaatcagtaaattaatatgaagaacttaaaacacagttctagccaaagtaatgcttaataagtacagtattgtgcaattattgctaaatagcatacatttattgtgttcctccatttaagatactttcaagcattgtagggaaagaaaagcacataagctgtagtctttagctttaacggacttgtagcctagttgagagaagccatatgtgtaagatgacgagtaatagcacaaagcagtgtgtgatcagtgccaaatgcaaatatgtactaaaggagtttaaagcacagagaaagtttgctgtgaactggaataatgataacaatggtagcaacagcagccagcatttactgagtgcttcccgtgtgctaagtactgatcaagtctcttacaggtattcgctcatttattctttatgtcagccatataagaaagatgtttctattagttttcctgctttacagctcagaaaactgagtgaggttagctaacaggcccagggtcccacaccagggaaatgtggagtctgggctgcctgttagagtcttggctgcctgactccagagccccagtcttagccacgtcagggtggtctaggagaactggatcgaagtagataccttacgggcaaaggaagccgaccacctcatggaagagtctggtgtatacaggaaaagagtgaaaggtacaatgttggggcatgattaaagggcctttagcccccgttaaaggcactttgacctgatccagaaagtagtgggagaaccagcgaatgaacttagcaagaggaatgttgggtgcattgcagggcagccactatggctcaagttggggctttctgatgctttctgcttcagtctcgtggctgtctagtggtttgattttccattagccctttctcccttggccttaagggatggatatctacaaaatcttagctatcaggcaaaacctcactgtcccactggtgataagctgggcttcccagcagttcatacgaggcctgcatcctgctgtgtaacctgcctcaagactgcagaaggcagagttaggtgtccttccccctcagggccctctttatgcttctctggatttggtgccaaagaatccacagtttagggcaaccgtagaaaccccaggaggagtgtggtagcgtgtggagaccctactaagataaccatagccttagctgctccttgaggtctggctctgggtcccaggggctgcttagaaggatccttagtgatcccctggtcaggacatcatatgtttagagagcaaggttagaggagttaccacagttttcttctacatgctgattaatctaggatttaaatacaggctccaaaataaagtgtaagtggtggtagctcaaagaagcaaagcaagcttcacattaaatgacatgggcttctgaaaatgtgggaaggactaggaacacaggctacttactgcatctataactctctttagacaaagaaaatatgtgattaggaaatgttttggcaagatctcaccaagattatttactgcaaaggaggcccaggactcagcctggcagggaaaatggggcgggggggcgggagtgtttactgggagtatggaagagcattttaaagtatggaagtagattgaacccctgtgctggggctggggacagggagtaccataatacaattttatgctgttaggggatctctgcaaaacctagagtaagtagaggaaggagtctgtttgaaattaggaatagtagggtcagggtccagatggaggtggggaggagtggggctcagacctgaccactgcttctctaggcgtcgtttgaatatttaaagacaaagcacagtacatttgctattttattttattttatttcattttatttcatttcattttaaaccatggctaactcttctccagtcttctccaggagaaaaaacttgattgtcatcctggcacaaaaatgtccacagttaggctaacaggcaagcttccgtgagcagatcaaatttgctattctggttccaacatttaactccctagctttttttaaaagaaaaaataagctggcatcaactgaaatttcaggttaggggcttggtttgaggatgtttggggaagcgggagctttctgccatgtcttttgtggacattggatgtatttccgcattctggttggccacatttccccctggggcagattcttcagaatcatttgtctcccactgggagtctttttccctcccccccccccccacccccctttgtctttttctctgacatctgccgcacactctctccagggcatacggtccagaccctcctgggagagcttcatctgcttagtataacttctagcagaagatagaactgatggattttcgtgcgcaaatacagattcacaagggtgttcggtgtcacaagcatggatttatgatgcagtttgaaaagggtcagaatattcagagatgagattaatgccagcccatgagtgctttgtggtgctgaggtaactgaagtgcatctggtggtgtccagagctcaagtccccactgcagacgccaggaagaaagaggtggctcgcagactgagaaggggcgtagggatgcacccttcttgtctccttctgcttgataatttagatagaggatggcaggtgtaaatcagtttgtggtagatgcagtgtgagctgtcctttctcccccttcctcacgtccttacaagacacctgtctgctttgtatcgattccggcactgtgttatgatattcttgtagtttcatttttttgttgtttctcttttgatattggactttatatgcaaagaatgggattagtcataatctttacttcaaaacacattatcttcatatttttatgctggttgtgatggcacacacctgtagtctgagctactctggagactgaggtgggagaatcacttgagctcaggagttcgagtctgcagtgagctatgattgtaccaccgcaccctagccaggacaacggagcaagactctgtctctaaaaaagatagaatgggctgggcacggtggctcatgcgtgtaatcctagctctttgggaggctgaggcaggcagaccacttgaggtgcagttcaagaccagcctggccaacatggtgaaaccccatctctactaaaaatatgaaaattagccgggtgtggtggcgggcgccggtagtcccagctactcgggaggctgagccaggagaatcgcttgaacctgggaggcagaagttgcaggaagccaagattgtgccactgcactccagcctgggcgacagagtgagactctgtctctaaataaataaataaataaataaaattatataaaataaatagtgtaataaccaactatgtagtcacttcaggctgctataacaaaacacataaactgagtggcttataaacaacagaatttgattctttccgtctggaggctggtagtctgaggtcagggtgcccaaatggtcaaattctggtaagggccctctcctgggtttcaggctgctgacttctcactgtgtcctcacatggcagaagggcggggagctctctaaggcctcttttatacgaacctaaatcccatccatgagggctctaccctcatgacttaaaacaccttctagaggccccatctctaaataccatcacattgagagttaggatttcaacatacgaattctggggtaacacaaaccttgtctgtagcagtgaccataaacccatccccccagacaaatctaggacctggagcataacctgcgtctgagcagattgccatccttcccacacctcctctcccttcttttctctacccaaggtaactattatctgaaccctgtatacatctatgtttccttttctgcatactttatttcgcttacatatcgttctaaaatggaacacataaaaacataagacatacacacataaaaagtatgtagctatatagatatgtatttaattgttatcacctttcaactttataaaaaggatatcagaccatatataatcttttgggacttacttttttacttaacgtctcgactgccagcattcatgtgtattgctatgcatcacggtagttaatttgccttgtctgctgtatgatgttccatcatgagccgattatacacagtttattcattcactctctcattgatgggcgttgaagttggtgctaggatcttggcaattgcaaacaggtttgccataaatatattcatgtatgtataatcagttgtccacgtgcaaaagagagtcctttgtgttcgtgactccattattttgaaaccagcagtagtactgcacactgggagaatgtttgtgggaagcacaataaaggtaagtcctcagtactttgtatttcagtttggtgtgaagaagtagcatgtagacttcataggagacaagacacttctatggtttgagtatttgtctcctccaaaattcatgttgaaacttaatgccttaatccccggtatggcagtattgacacatggggcctttaagaggtggttgggtcatgagggttctgccctcatgaatagattaccccattcatgggttaatggattaatggattaatgggttattatgggaatgggactggtggctttataagaagaggaagagagacctgagctagcatgctctgccccttaccttgtgttaccctgcactgtcctggaactctgctgagtccctcctagcgtgaaagccctctccagatggggccccttgaccttggactccctagcctccataactgtaagaaataaatttcatttctttgtaaattacctagttttagggatttggttataagcaacagaagacggactacatatcttattttaattttgttcctcccactaacttcccagccccacagtgcttggagcaactgtttctgcagtcatgacttcagtacagttaatgcctgttgacttcatcttatgttaaattctttgcaggtaaagccatgttccttataagatcagtctttttttgttcctctatgtgtctaatcaggtcaattctttgcattattttatttagcatcatctaccaggaactaggcaggcattgtcttaataaagcctggttcttgcagttggagaacttgctatctagctgggagaggcagtatgcaaactaagatttagaatgcgttatgaggccaggcgtggtggttcacgcctgtaatcgcagcactgggaggctgaggcggatggattgcctgagcccaggagttcaagaccagcctgggcaacatgacgaagccatctctacaaaaaattagccaggcatggtggcacatgcctgtggtcctagctacccgggaggctaaggtgggagaatcacctgagcccaggaggttgaggctgcagtgagctgtgattgcaccactgcactctagcctgggcgacaggatgagaccctgtttcaagaatagtaataataataaatttaaaaataaaatagaatgcattattatatgtaccttagaacttaggtcttagagagtgcctacctctccttgggagagaagacttacggtggtgggagacagtgttgcatctgtcagataaattagggaaggcacatggggcggacgatttcagagaagttaaaggcatgggagaacatttgccacgcaggccgtggcaagtggttggctttgactgtaacatgcagcgtatgcagttcctggaggcagatgagggaagtcatgcagtacttgtgtttctgtgagtctcttcagttttggggtttgtagacaggtcatgttcacttactcctaacctgtctcccacaatagtcatctgggtctgtgctacttagtgtcatcctctcactctttcccttggtggcatatccagttggctaagaggacaggcctgaccttgtgcccagagtagggagaagatcccgatcacctctggtccttgtcaggctgtttgcttggatggtagagttcacccaagttcggactcaggaacggcctgtggtcatggagtagtttttttctgtccagggtctggaccaagataactccatcacaggggtagcaacagtatgtgctggggcaattctgctacccacttctggtgtccttcagtgctttccctgcactatctctgtccccagctgcttccatccatttgctttctagtgatgaagcactgggggaagctgcagggatggctgctgcacccacatccatccctgcccatctgttctcagagactctatggctagcagagggagtgatgatttcagggaagagtaccagagagggccagtgggtagcaggagtctcacttcttggagaaaacagctggtcctctgtgaccaattctccctcaaactagggagattatatggccactgcatacacaaacacacatgcttgcgaagataggatggagttgtaccaaataaaaagtttattgaaagggatggtggtagagaaacactgtatcatgccgtggcataacagggtattatatgttggatggctttttggaaatcattttaggccaaccttattagagatctaatttatttgtattcttgtagctacctagcacagtggtaagaacacagaccaacatttggtaaaccttggtttgaactctacccctgctgcttctgacctctgtgagtctgcatattatttaacccctgaggctcagtgtcctcggttgaaaaatgggccactaatttagtataagggctatgtaagatgtaatgcacatgacatgttttataatagcttcttatggaattatctgaattggggacccatctgttgcttttataaaaagttcaccccttaagacaagtcagtccaatggccatgtttaaaccaaatgtactgtcttctgtaatgctcaatatatttttcatgtcattgagtgcagagactaggtgggaagatgatcatatacagacagaatgggcaccactctgcctaaacatggctctcgctttcaaaacagtactttaaaatatctcctccctattaaacttttccagtgaagactctttttccacctggttattgtctctgtgtttgttacagccttctctctgctttcagatattcaactctgcaaagtcgtaatcatttatccacatgtacttttgtgtgtgtttgtcccatctctctctttagaagacatgttcctgctggtgcttggaataagacgttcttttccctccccgtggagatgctatttttcctctctttaaggagctaggagagaatttggttcaacatgtcttatgtatcagtttagcactgtgcttttcttcccttagattgacgtgtgatttaaaaaaacaaaatttggaaccggtcatgtaaagatggtgtatgtcacttagtataggtcatctctgtaccctttgtatactgaattttgctgtgacctgtcaaaggataccgaagacaggcccatgcgaaacatttaatttctggcattttcgtgcatgtgagactcatctgatgtgaactgaaggtatgttatccttccttttaatgataccaaatctggcccaaattcatatgaccccttagaaaattactgtgataggaacagattctaatgaattgaaatagagatttctccacctcacgtaattaggatttgagagttaaataagaaagtcagggatagggacagggatagaatggcatggagaaagttggagccaagaacactgaggaaaagaagggagtgacagcagcaaggaccattgctgttaggaagggaattctttcatcagacactggaattctcctgccaggcactggagtttgccctagcttctgtctgcttttactggatcctgggtcctccagctgaagtgagttgtattacaatcccttccagttttgcacttcagggaagtgaaatggagcaaatcctaatggcacaggctggagggagaaggactagtttctttaatgtgactcaacacctggcaaggctgtctttttctcaaccgggtttcatctgttagttctgcaacatgcagagtcagattttgaggagtttccagctctcgccttcatggctgtccttgtgtttgtgtttgtgttctccaggcgcctccttctccactctttctccagtgctggagacctaggggtgtgcatcctggaggattgtgaggaacctcagctgctcccctcgtcctctgaccaggcggtgggctcagggagctttggagtctcatgcggtcagcagcgcttagcatgttcagttggctttttccatatcaccagtgacatctttcttcttcctaatcatcgactcatggaatattagaattaccaagcctcttgcagttcctgtggtctaattccttcattttagagatgaggacccctaaggcctggggaggggagatgataggtgtagggaaaaaaaaaagaaactttttcctctaaataagattagcaaaacgataaattaacaggagaaaaatagagagtttattaacacgtgcagcacacatcacacaggagaaacctcagtgatgagtaactcaaagtttcaagagtttttatttcttttttctgtatagcacttgtcagtctctgatattgatttttacttgtttcttaatgtttgttctccttccactagtacgtacactccatgggaacagtgattttcatctgtttgtcactgctttattcccagcacatagagctgtgcctagagtggtaggcagatcattgttaaaacaatgaatacatgaacttcgggcaagttacttaaccattctgtacttcagttttcttgtgagtaaaatagggattaaaatagtgcctacttcatggagttgcaataaaaactaagggagttaatccatctaaagtaccaataacccacctggcccatagtaaatgctcaataaataggttcccagccaggcgcagtggctcacacctgtaatcccagcatttgagaagccgaggcaagaggatcacttgagtcaggagttcgataccagcctgggcaagtggtgaaaccccatctcaactaaagatacaaaaattagctgggtatggtagcaggggcctgtaaacccagctattcaggaggctgaggcagaagaattgcctgaacccgggagatggaggttgcagtgagctgagatcatgccactgcactttagcctgggcaacagagtataagactctgtctcaaaaaaataataataaaaataaataagttccttattataattactaaatattgtatttcctcactagaatgcaaactccttgagggcagagactatttcttacatcatctttttatttctagtagcaatttggctgacacatgattgatattcagtgtttgttgaacagatagataagttatagaaaaattgtaggtaatacttctgtaaataattgttaaatttaaatgaatagatttccttcctgtctttttccctaagctgcaatcagtgaatctacatggattacatagattgtgactacactgtgccttaactcatcacttaggcagtggagtcgatcatttattttgttgccatgacttggctgaaatttcttggggactgacagcaatggcagaaacttgatgggtcctgaatgtcaccatagcctgtaagctacacaggagccacccgagaactcctccattcgtggttgtaacttcacagaaatgcttcccagtcagaggaggtacttagcagaggctgcaggcatctgaacagacaggtgcaggaaaagttgaaagggaaggttaagggagaaacatactcctcatctccgttctcaagaaacggcttaaaggttgtaaaaggattctgcttttaagcttgagtcactcatttgacttctgtgggccttgcaatttctctggtaaaattagagaatatgaccaagattatctccaaggacctgtcttactttttaagtttcctaattctgtgaaaaatgcttaagaaggcctcagactgattaagaatttaggggtgtaagtttaagtggggatactgataaaagggcaggggatgttactgtaagagcaatggaaaagtgtctgagtagtgtagcatatccatttgtgagaggagtaattaattaaaaaatgaaggcagaatccacatcttcacaaaagtttcctatctcctggtttggatgagtgtatttaatgtgaactaagttgcatgtgggctgtctaatctgggcatctgacttgtgaatccttcccataactaagccccgagagatttccaatcatgcccataaggtaatgcaatttggcaagaggatttggacttgacgaaatctcttgttctatttggcatccagaaaaggctgacttgcctaatttgaaaataaattgaaaacaaaaaaaatttaaaaaaacctctggttgttccttgtttgatgaaataccatagaaaactattactctttttccataccccattactatggagaatatgtttttaccactgactcttctaagtatctgtccttagtttcctgtccttccctgccacaggttccaggaaggctgaatcactacagcatggtattaaatcatagaaatacgtgtgtattttgtaccatgtgggtctgcttgcattcctaacatctgcattagtattagttttctattgctgcataacaaactgccacaaatttagtggtttaaaacaacattcatttcttatctcagtttctttgggtcaagaatctggacacagtttacctgggtcatctgcaaagggtctcagaaggctgtaattaatgtgttagccagggctgtgttctgatctgaggcttgactgaggaagaacccactttgttagcagaatttagtaccttgtggttgtaggacagaggattttagtttcttactagctgttggttggaggcttccctctgttccatactatgtgggcctcccaacctagacacccacaacatggcagcctgctccttcaacaactagcaagggagtttaatgttttcctgtagctcatatttctttataggtgtgacctcaatttttcccctaatacctttgtaagatagaagtagggagaaccaagatagatccaaaaaggctgaatgaaatgcctgagattgagctggtggttgcattgaacaatataaattgatgaataacaatttattaattgtgccaggcactgtgctaagagcttcatgtcagtacattcttgtttagttcttagcacaaccctctgagttaggtattactactactaaactatttaacaggtagggaagttggggattagagaggttatgtaacctgcctaaagttcacagacagaaagtgcacagcccagatttgaacacaggcagattccagaacccactatcatcgcactctgaagatctctccattagagcacgatgctgccatgttcaggattcttcctatcttttgttaaatacttaagttcctgcaatattgcaaagggataattgtaataggttgcccctttcaaagtgctttaataaaatgaaaggacaacattctttcttttctgcttgagccaggctttctcatttttctgaagacatctaggataaatggaaggaaaccagaatttagtggggtttgcatgtattgataacagttttgctgaatacacatccaagagctaaaacatgcaaactcttcaaaattggtagaatacagcttgctcattttaattcatttaaaaatgttcattttaattaagcattacccattttattattccataaaacacgaatcatctggaaaaggcagcataggtctatttttccagcctataaaactatatgtagatggatcttgatgagggatgtacaagatttaattagaaactgaaattttagagtaaaaaaatgcaggggtgtgtgtgtttcttctatatttgtggaaacccaaagagctatcctgcaggatacttgaaaatatatataaatacagaggagaaataaagtgcggagaaggtttgttgattattgagctttttcatgggtgatagaatggagcagctgtaggatggaggtaaagaggataggaaaatgctcttctgggtcagacccagccccacatcccaaaatgttgtggccaccctctgtgttatgtaaaatgtaggaaggtcctcccagctggaggaccttcgagtatactgcgttccccctcctcattcactagggaggatgcaaaggtgcaaatgggccaaggtcatgcattggacttccttcattaaactgttatgaatttgccttccctgagctcctgttggaaaaatgtcttgaacttactgttgttgtttctcctactgcgtttgtatttctttttataaaccttagtccaagtcagcccagtgctgtagttatttgtgtatctgtgtcattctccctaggatgccctgggccatttttaatcaactttgatcccctttcagtgccttgcatgaggcctggaacattggaggtacacactgtgtattgactgaatcgagtgaaaggtatttgaatatacagttgactcttgagctacatgggggttaggttgctgacccctcacgcaggaaaaatatctgtgtataactttttaaaaaataaatttgggggtacaagtgcagttttgttacatggatatattgtgtagtggtgaagtctgggcttttaatatagccttcaccctagtagtgaacattgtacccaataggtaggttttcaaccttaacctgcctcctatctttggagtctccaatatatgttatttccctctgtatgttcctgtatacccattctttagctcctgcttataagtgagaacatgcaatatcttactttctgtttctgagttatgtatataacttctgagtccccaaaaacataactactaatagcctactgctgactagaagctttaccgataacgtaaatggttaattaacacatattttgtttgttatatgtattatatactatattcttatagtacagtaagctaaagaaaagaaaatgctattaagaaaatcataggagaaaatatatttaccgttcattaagtggaagtggagcatcataaaggtcttcatcttcatcatcttcatgttgagtaggctgaagagggcttggtcttgctgtctcagggtggcagaggtggaagatgcggaggaggcgggaggaaaggcaggccactcagtgtaaatttactgaaaaaaattcacatataagtggacacacgcagctcaaacatgctgttcgagggtccactgtatttcatctgtttgtttcctactgtggaagacagggcttccaggctttagttctaaaacttccattgtaaggccttgaggaggatcctctcattccagtaatctgagagttggtaaacaaattcaaagccactgtatcactgtcctttatgtccctatgttttttttttttacttttttttgccatttcttttttcttttgcactttaaaaatcgtggtaatatatacataatataaaatttgcccttttaaccattttaagtatacaattcagtagcattaggtacattcacattgttgtgcaaccatcagcgctctccagaacttttacatcgtccccagctgaaactctgtccccagcaaacgctggcatgcccttctcccctcccccagcccctggtaatcaggggtcttcttcctgtttgtgaattatgactactccaggtctctccgtaagtggaatctcatttgaccttttgtgactggcttatttcacttagcatgatgttaaaaggtttatccatgttgtagcatgtgtcagaatttcattcctttttggcagccattgtcttaagactcaagagtttaagtgtttttagtctctgtagccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaagtggagagagtgtggggaatgacattagggcgtatatgaatgccatgctaaggattggggtacaggtaacttggaggcctcatgcagttagactgaccccgttcgatctgtgggttgacaggggggtgtgaatggattggaatgggagagaccactgtgtggggcaaatgggaagggagcgtggttgcagcattttaggccagagatggtgagggcctgaagcaaggcagtgagagagaagaatttgctcatggtcaggtgcatcgggcctgttgacagcagagtttgttggactgctcccacctattgctttttgtcttctgaagtttttataatttcaattccagtttagaggtctgtttttagaacatttctccgatcttattatacccatagtggcaagaatgaattgatttgtacaagatagctggacaggttcctaccttcaggctttctacccaactgggcacttggaaggatagtttttcatagtcttcatgggctaagtgattgcatgtaatatacaatagctggagtctaactgtaattaaaacaggttagccaagctacaggagaagtatcccccccatccccacccccatggcccttccccactgcctgtaatctcttggtaacaaaagaagtcaaacaaaaatttcatgcaagggtataaacatactttgagtcatcagaacctacctagtggtccatagaaccttggctcttcatgaagggcttaccaggaagacatagtcgttgttcatatgcagtttctattctgaactgtaaaatgtgagcgattactttggaaaattagaagaaaaaatgaatttactcaggatccttaaaaggttacatttgtcatgcctgtaatcccaacaattttggaggctgagccgggtagatcgcttgagcccaggagtttaagaccagcctgggcaacatggcaaaaccctgttgatacaaaaaatacaaaaattagctgggcgtggtggcacatgcctgtagtcccggctacctgaaaggctgaggtgggaggatgacctgagtccggagaggttgaggctgcagtgagtcaagatcgtgccactgcaccccagcctgggtgacagagtgagacctcctctggaagaaaacaaacaagtgacatttataggagggtcccaaacatacaaatatggaaagtgaaaatactacttgctacaggtactgaaagaaaatactcaggagtcattattcaactgaaagcagattgaggcaaaggtgctgaaatatactaaaaataatgagtttcaaagaaaatcatcttttgttaacctttgcattagtcagtccttattttttcgttttagtcactcctttacaacaatgtgtataaatatagaagatgaagagaagtgtgataaaaataatttaagatttggaacatgggttttcaaaggaaaggttagagaaatttggggattaaaatggacagactttatcatcttcaatattaaaaaaaaaaacagaaggatatttacgagcaagccaatgaaatgataccaagaagtttataacacatactctgcccttatggggctttcacctagcggccatgtttccattgtgcagttaactactcagttattttttatttcccaagagcactaagtgaaagcaaatgcatgttaagtcgtgggggctattctgaatgatcaatagagcccaccagagtcccttataactaactacccattagcagatgtggagtttccttcttggggatggaggggactgagtcggggagcttcctggatgggagtttgaaccaaataatcttaattatgtaattcctttcaattttaagatttgagggcaactttagaaagagataagtaattgactgaccaactttataaagagatcagtaattgaccacccttggagtgtaagagtcaacacctaaaataaatgtatatttctaatattttgaaaatagaagaaaaaggaagaaaggaggaaagacaagttatctagtggagacgatgaattttcaggtcatccttctagtttttattttagacttgtgtctttagttgaaattattacaacttgcatgtattttgtctgtttactcattatttcgtctgtctcaccgttccaaggtaagcaccgtgaaaacggactgtgtctttttagttctttactgtgtttctgccatcaagcccagtgttgacacatggtaggtactcaagacatgctggctgaatgaatcagtgagtagtgaaggtggatcatggggagaagagtgctgcaaataccagagagaaggagaagaaggaagtggaggggatagcggaagaaggggaagaggagtgagtttacaaggcctttttttctttttttgacagagtctcactctgttgcccaggctggaatacagtggcgtgatctcagctcactgcaacctctgcctcccaggtttaagcgattctcctgtcccagcctcccgagcagctgggattacaggtgcacgccaccacaaccggctaatttttgtatttttagtagagatgggatttcaccatgttggccaggctagtctcaaactcctaacctcaagtgttccgcccaccttggcctctcccttgctgggattacaggtgtgagccaccatgcccagcctccaagccctttcttttaaaaaataaattttattgtttatatttgagatttacaacatgatattatgggatacatatagctaatagaatgggttgctatagtgaggtaggcaaccattctcacaggggtttgtgtgtgtgtgtgtgtgtgtgggacaagaacaactaaaatctacatatttaacaaaaattcctaatagaatatagttttattaagccttaaaaaaggagatcttgccatttgccacaacatggatagacctagaggacattatgataagtgacataagccagatacagaaagaaacatattgtatgatctcacttttatctgaaatatttattttaaaagctcaaatacagagacagagaatgaaacagtggttaatgccggtggaaatggggagatgtgggtcaaaggacacaaaatggcaagtgcacaggatgagcgtgtctagagacttaatgtacaacgcaaagactaaagttaacaaggccttttggttctgttgctgttgttgcattacgtaatagtgtgctaagaacaggagacacataacgtcatctaaaaaacaggagatgaagtgggccggtgctcaaacatgctagctccgggaaacaattcaggatgatttgccactgagtcaggtttgttaattttttctacaatagccaaaggctctcaaaaaatcaaggtttcctggtttataaataatctctggaggggtgtgtgtgtttcaggcatctgactcctttatttatattctctgccctggccttcagatgattttcgagcggctttcgattagattatctgcattgggataatggagcaattttgcagcaaactgctttggactgttcgactcttctcggcctgagtagccaaaaaataataataacttgatttagtctggtctagcctgctgtagtctgacttaaggatataatatcccagaccttagacacttgacttaatacattaacatattaacaaaagggtaaaacaaaatactagaagaaaacataataaaaacagcacattatttttcgggcatttgacttgaaccacagggtgccctcataatgaaaagaatattccaagggaaagatgagaaggcaattgagacaaccctaagcccctgtctgcccactcaaaccctctggccaccactgtactctctccaccatgagaaagcaggccaggagtcagttcagctgcctgtgtttaagtgcttttaatatccatggaggcacagagaaatgaaagcaggagccttgaatctagatttttccagaatccttttgagagacttattgtagcggcaggagctccattttgggggggtcaccccctgaactttgatggttttcaaatctttggagggccttggtcttagtggctcagaggtcccctgccaggacttctttaggatggggatgataggaagcgaacgttccttctgttgaggtgcatcagccttgcatctgagttcttgatgtcctcaggcctggcttcccagttggttaaaggaatgaaaataacaacgcctttcatttgcagtgcagctttaaaaatatttgcttttgctatctcattttatcctgataataaccgtgtgagaaaagcaggatggcagtcttactgtccttgtacacatggagaaatagatgcacagaggttaagttgcccagtttagtaaagggcagagcagggactagactccatttctcttcgctggaagagcccagcactatcacattgcaagattgtttcttgtaaaacagtcctgcataaaaataaaaaagagtagagagcatgatgtgaatttcagcttttagaggctgctgtctgtttttcataggttaaatagtgaatcagtgtgctccgagcttccatgaggggcagccctccttacctggcaggttactgagttttctaatgacttcagttttaggtgctaggagatagtagggccacctgcactgttttgtgagcaggacagataagaggcaagtggagagggtgggagagcactggcttgcatcatacaccccagctgcccttgcagggcccgactgttacaagccaggtatttctaggacgattgcattcctagccatatctgttttctttcagatggggcgtacaatttaccttttgagttctgtaaatggaatcgaggtgaaatctttactctggtgcacatatgacctgcaggttgatgctgcttgtttggaaagccctctacttcacagcgaacagtttgtactgtcaggtagacctctctgccaggggaccaactcctgtgtatttgaaaaggaagacaaacctgtattttgtagaaagggtctattgttcccagggggtggttgtggccaacttcttggactcctttggctgactctgaagaaggaattgaagtcagaatgctaatcactgacttgcacaggcctcaacaatcaaacctcagggaactcagaagaaagtaaacaagagcgctcaattgcagagtcttgaagaagagcagctgtgtaaaggaggctagacgtgaaaaaaacgtgttggagaggaaaaaaaatcacattccctgcttctcaaatgggaagtcttaaaaataataaagaatcctgagcagcgggctcatttcccatgagcaggcttgctgtggcaggcaggctcacctgctagaggtggtctcctggcttagaatgggagcacacctgtgggaatcgcagcgcttctctacctgagctggatgtagattgtttgaaaatcctagttgtgcactgcgtttccatcgatccctttcatgctcccacttgttcctttagttccaaatagcaggctggtgttgagaattctgtcatcatggggcgtttttttctaaatgtgagaaatgtcggaagcatgggtgttctcagattgctttagccactgatgattttccttttagtgtatggaaagaatgattttcttctcaatttctcccctctaacctcctgcatgtagatttatggattctaatcgggacctttctttgattcagtgccaggtacacaggccccgagtcgtatgtggcaagtggccaaggggatcggtcctggagaacgtcatggcacacaggcattggccatggagtggtgatccctggctctggttcttctccgtccagtgacctggcatgtcacctcacagggccatatttacctgttaactgagaaactgaactagaacatggttatgataattttaatctcaactttgtctcctcctatcttatggcagtaaagtgaccttttagcaggatcaatttataagccgtttgaagtctatcttttcttcccttagcagttgtatttgtgattttctcagcctgattttaagttattctgttataattttgaatgttctgttatgcttccctctgtggtgagcatacgtcgaaagctgtacatttccttcagggtaacctttgtttccaacaggagagagttctcactaccacatccagccttgatctctttaacctaaattggaataagccagacagagctggggttcatgggacagatgggagcatctcaagtttagggttggggagtctcagtgaaaaaaaaaaaaaaaagaacaagaatgtagacttggaatttgagaacagataaagcagtcctcacttgtgctctgcaagggagtgctgttgtcttctaaggtattgaacagactgggtgggaagctgctgaaagactggaaatttggggacttagcaagaagtataatggtgctgtaactgcgttttcttaaggaaacttggagctgaggtgccacctccctgggagggacttttccactggtttcttgcagtctggacatcacagacggcccagactcccccctgtcttgtgtacattcccttctacaagccttgctgtgttatcacaggtaccacttgtaggccagtatcatgggggatggacattgtttcattctaggcacattcaggaatcgtatatgtaccctgcctcgcttctgacctctcaagtcaacttttggagctgttagtgacttccagaaagctgacacccagtgccactcaaccaaccctgcttttctgctggtttatttttgttattcctaccccgactcatcttgcttttcagccatcaatgagaatttattgagttactcagacactcactcagaccctgtgggagagtagaaagatgtgtaagaaactgtcccagaattttgagggacttaaaatccattcgaaaaggcaaggtctaagcacatgaaaagttacctagcaatatcagctcatgaatggagagacagttgatcagagaaagagaaatgtctgttcaggagtggtcaggggaggctgcattgaggtgatgcacacgtgtggcctgaaagcttgattcgttccccaccccccattgtattctatatgtaatatttgatatataaccaagaagctatgtgagttacaaagcatgatgatacagtgaacacctatgaactcaccacccaacataagaaccaaaatgactgatattgataccctacctatatacctctaccttcttcctcattctacccctgccctcttatcccagttagccactgtcttaaattttacagattttattccgttcctttttttcttttttgaaagcgtttgatcttttcttctctcctcctctcctctcctctcctctcttcttcttttctttcttttcgagatgaggtctcgctatgttgtgcaggctggtctggaactcctgagctcaaatgatcctcccaccttaacctcccaatagctgagaatataggcctgtaccactgcacctggctagatctcatgttttctttggaaatctagtaattgtgatataggatctctgaatgcagaacacctagggcacaagtgatgcttaattttatgtgtcaacttagatgggccacagtgctcatatgtatgatcagatattcttctggatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctgctggcacatcttgcagattttgggcttgtctgcctctataagcacataagccagttccttaaaataaatatctgtgtgtgtgtatgcatttatatatacacacaccaccctattggttcactttctctggagaaccctgactaatacagcatatcacacctctctgtatgccacgtaggtagcactgcagaattaatttgcagagtattctcacatcgggaggtcagcagtatattaggcgcatatcagaaaggcatttggatgattctggcctacaccatggaagagaaaccttgattttctgtaaaagcaaggccagctttttttggagaactcttttctcccttttagtattctgtcccctcccaaagctccgtggctttctctggtcattcagagaccgttattccctccccagcatacatgcacactcatgtctatggtttcccgtaccttctctgtggagccctggttctgcctgttacaaggaaaggcatttagtttctctgacctcctgtctcctcagatgtcagtctgtatttattatgtgtcaccatgtactagatactgatttaagtgctttgcctgtttattccatggtattttcacaacaatcccaggtggtaactactatcatcttgttcattttgcagtgagaaaatggcaagaaagtcatagaaatgggatttgagtcctggtagtccgactttagagcgcttgcttctgacgcttctgaaacacattatgaactggaaattgctctacaaatatacactactgttagtatcacaatgctagtattatagtgcgcctattgccttggggccctgcgctctgctagttgatagctagggcatttttggagctgatgcaggctaatgagggtcgttgataggaaagtattgcttttcctagaaagctctggttctttgacagaagccttctggtggccacagttcctgagccctaagaagaaatcctgtagggtacctctaggacatgatggttagtgtagggtcatgagtctgctctctggtcatgtcaagaaagctgccccctactttgtgtttaagcagatcctggaggctgcaggatagcccattgagactaagtggagaccaggcatcaggtgaggaagccttagcttggagggtcagaggcctcagctagacttggtaaatatttggcacttcctctccctcacaggaccacagcaaatgttaaataatcacagcactctttagtttgaccaccactaatcgattgagttgggcaaatagcatggaaggtctttgcctattctttgggagctctgggtgtccccagagaattgagtctggcattaagttttgcctctcctttctcgttttcttttcccagccatatttctccaggttttcagcacaaactcaacccgttatttttgtttcttcagtgtctttaactctttccctgcctgttgagatggagtctcactcagttgtttagtaatggcagtacatcgagaagaccatcacacagcaagagttctaggagtttctttgcctgtgaggttagttttctatatttcatttgtggagggaacagaagtgatcccatttaagtgtggaaactttctttttggaacattttccttcctttttcttcatacatcgtggttccttctctcctgcactctcacatagataccagtatatagagatactgtttctaatcctgaaattccttttttgaagaaaagagaacattgtgtgccattgttttctgcgggagatctatgctgcgcttctgttttccaaacatttatccttaaagcattttcagatgtcagttaaacaagggagcaatggcccctgggtcctgttagggacatactcttaatgactgtaaaatgaataaggtatagaggaatattcgtctgaagtcatgatttgtacgtcatttccttgctttcttcaacatcattatttctgaaccagaaagtattttgatcaacattttggaggaagaattgtatggtatttcccaaccttccccccgtgggtggaattgcatcactgaatcacttttctctatttttttccactttctgtctcctgttttgtcaaggctccagcaaactccagccttttttctgtgttttttagtcctaaaattctagcctggcatctgcgattgtgttagtttcccatcattattttctagcctaacaaggaagcctcgtgaaaacaaagcgttctgtttaatcctcaggtggacgtttgaaccctcgtaaacatgctcccttcacccccccatcttactttttagcaatctcagagatcaaaaagacagtcatctcatccagtgtagacaaagtgaagtacattcctttcatttgcctttgctgtagtccctatttcatccatctaatccgttttaagggataaaattgcaattacaaacatttcatgtgtggtcagatttttagtattttaatctggtctgagacttaagatgaaatgacagttctaacagaggtcctgtgtggaagaaaggacctaggtgccagtctcagtccagtcccttcttagacgtgtgactttggaaaacctctcagagacccatcatctcgtcgtagatggggatggtattacaggtcgtgctcatctgtgttaatcagggttctccagagaaacagaaccaataggagatccacatcgctgttgatgtcaatagatagataggtgtgtatgtagggatggcaggctggagaccctgggaagagttgatgttgcagtcaggaggctgaacttcctcttccttgggagacccaagtttttttctcttaaggccttcaactgattggttgaggcccacccatattatggagggcaatctgcttcactcagagtctactgacttaaatgtccatctcatctaaacggtatcttcacggtgttcaggcaaatatcggtgccacgtcctagtcaagttgacacctgaaatcaaccatccccctcgcaggagtttgtgagcatcaggtgtgaatggtcaggagctgcaggcgtgcacggaggaggccactgttcttcatgcttgagccttttctgtttctgcctcgtttactttccttctctctcctcactgttacccttttcctcctacctctgacacctgcccttcacctcccacctgctacctgagatgggagccacacgtgaagtgagaagaagggagaatgaccaggtgggtgatgaatttaaactggaaagagaacagatcctgatgccagtcaggatagaggtggtctagctcttatgtgatcatgggcaagtgaacatgcctcagtgagcctctgatcagtttctgtatgaggataattatatttatcctctaaaatgaggataatgatatttatctgatacagttcttctgccctaacacatacgtgtgcattgcctttgctttcaaatgtttggtaatcacctttttagatttaaatcattactcaaattgaactctccttcagcctttgtgtgtctagactttccgttaagattagattacttgttttactatgattgtaaaccattgtttccatgaagtctcatagcaaatgttcttttgctttcctcttttgttactagtctcttgttatttctcaaacatatcaagcgcacttctccctcagggcctttgcgtgtgctgtttcctctacatggagctcagatgactgcatgtctttttcctaaacttctttgaggtgtctgttcaaatgtcttccactcaggggggctttccctgagcaccttatagaaaataaataaaatgatataatatctgctctcacgttctgttgcacttgccttgctttgtttttcttcatagtctttatctggaatatatatttatttctgtctacatcctcccactaggacagtggttcttaaccttggatgttcattagaatcaccctgggagtttaaaaaaatcctctcctgtgttctagaacaattaaattcagtaatgttataaggaagagactcagcattagtattttgtaaaactcccaggagattcctatgtgcaaccaagcttgagaaccagtgttctagtctagaaccttacttcccagaggatgtggactggtggcatcagcatcacctttatttgaaagctgagtccaattcttctctttggcaggacccacagatgatgcatatgacattaaagcttgagatgcactgcactagaatgcaggggcgtcattttgcttgctgctgtatccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgaaaaaaaaaaaaaaaaaaaaaaagatctgtgatggaagacacttacagacatgtagacagggtggtgtggaaggtctacagtaagtgactgtttcagactgaggggagggagtagactcctggtgaggagggcaggggcatgtgagttgcgtatgtgagtggctggaacacaaggtggggaggcatgcttgtgtgctttggcaatcacaaagacggttagaaggcagttaaagggttggagtatggtcagttctgtgttttgaagagatgactgacagtcgtggaaggtggattggagaaggaagaccatgggcccatcacacccagtttggagatgattaaagatgatacccacgttacatgacagagccgtggcaggggcaataggatgtaaaatgtggagatcgttttgagatttttcaaatggggaagaccatgtcttttttgtttaaccgaaatgagcaggaattcttggggtgacatcaaattcgatagttctatgagcatatacactgaaaaccacgatattacggaaatataggctatttctcttttcactggcctttagatagactggattagtggagagttgagcattcgtcttttcttagagccttgagtggagatggaccctagtgattatttattttgactgctttattttgaagatgaagagaaggaggccaaggtatgaaatgattatcagaaccaggaatgcaacttgaggtcaccattactagatacatagtgagtgccaggtggtttaaatactcattatcaccttcaatcctcacaaccattgtatgaaacagggatgctatgtttattttagggatgagaaaacccaaaactcaaggaggtaactcacccaaggttttgcagctagtaagtggtacagctgggatccaaacccaggtgtgtcccagctacgctgtgccatctactcctctgccctgctgctttcctaatcagtactccctgatgctgctgaggaagagtcgaacttatagaggtcacacattgttttccttgtttttggatgcagttttgttttctttgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggtggctgacgcctgtaatcccaacactttgggaggccgaggcgggtggatcacgaggtcgggagatcaagaccatcctggctaacatgaaaattagccgggcatggtggtgggcgcctgtagtcccagctactcgggaggctgaggcaggagaatagcgtgaatctgggaggctgagcttgcagtgagcggagatcatgccactgcactccagcctgggcgacagagcaagactccttctcaaaaaaaaaaaaaaaaaaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacagagtgtagtaacaagcaggggtgctatggaatattcatttatcctaaataaatatctttttggcaactgcttttccctatagtgtaatacagtaacgctatggggcatgtatacatgtgtgtgcataaggaacatccgtccatctctagctgtcatgtctgagaacattaataaaaggctcgacctcatgcgcctgcaagtgatcacaagacagttactgaagcattcaaagaagcaatgtctttgtcatctgactcattttgaaaacgcatgagaatgctttcccaaggcaatttcttacaaaatacaccgtgggacatttttcctatagtttattgttgttgatgatcatcgagaactttgtacccagagacactctacactgtgagtgtcccctgatattccctcccactcagcctgatcagtggtatctgacctccaactactcgctgcaacaacccgttctctagctgagtgggcctggactttgaacagaattaacagcctggaagtggagttctcaatctcaacagccccttacctcatgcaaatttcttttgagctgaaaagaacaaacagaatgccaccttttaaaacaaccttcttcgaaacatggggggaaagtcaggttttatataaatcagagagatagaaataaggcccataataaaaaacttgaaatagatttgggaagtttccgaaacttccaaaaactagtggtccaaagtgggcaatattttttgtgtgcattgagaggcccttcctgtttccttggtccatgctggtgtcttgccccgttccaggaaccctgggctcccctgtgctgagcagcccccacacctcagcccaaagcctcaccccttgcctgaccacaccccatttcttttggcacagcttcccagacttacaagatgtcttgaagtgactgaatggagttagtgttcggcaggactggctaggtaactactgggacttggtgcagaatgtagatgtagggctccttgttcaaaaattaggaagaatttcaagatagccacagcagagcattaaaacaaacccaggttggctaggtgtggtggcacactcctgaaatcctagcactttgggaggacgaggcaggcggatcgcttgagctcaggagtttgagaccagcctgggcaacatgacgaaaccccatcgctactaaaaaaaaaaaaaaaaaaaaattagttgggcatggtggtgtgtgcctgtagtcccagctacttgggaggctgaggtgggaggcttgcttttaagcctgggaggcagcctgggcaacagagtgagactgtgtctcaaaaaaattctcagacaagcacaggacctctgtatgactgcacaggtcacaggtcgcacactcacgaagccagcccagtgctcaatactgtattttagaataagcaggaatcagtttagggctgccagacttgcagaacaatcactgtgagggctgatggcagatccctgatctgtgattcagaaagagtcattcagacaggcattgcccagagtctgggttctctctctcctgaagttgttgaggctgtgcagaatgtatgtgtttagtgtttcatccagtctgttagggtaatcagtgtgatttctctggcatctccaggactggaagcagaccagatttaatcaaagctgttgaagctgcccagggactggctaagctgccaccctgttagtgaggccgctggggagagggaaactgaagcctgcaccacggggagccgtatactggagtctggaatccatttgctccacgcaggaggcctgcatctcaagtcaggaggcactgcctggaaatctagcatcatgttgatactctttggtgaaggaaatgtggtccttgccccaagttatctcacagtccctttgggcaatctcatgcatattaaaaataccgacaaacatagacccacgaaagatcctgatcttttaggtctgtcatgtgatagagacagtaagtgctctgtatagacatcaggagattttcttccctgaaggacaagctcttgtagcattttcctgcactgagatgcagtcatgctagcctgtctttcactcaccagggatggcaaggaaggaccagctgacaagtaataaagcaaaccagtttgtaattttacagggctctgaataaagatgcatttatctctggccaacaccaagaggcctcgatgtctctcacagggaggaacttgatgggctgtggcgtcttttgggggtgctagggcagagtcaggcttgaatctgagaaaggcaagtctgtgcattaaaatccagcacgggggtgggtctggggcaagggacaagagagaagcgggaatggaaggcagggatgaggactggtaacagaccctctgcctccttccttcctcttccctcacactggctctttcagccacttccctcactgagataggaagcggtcctgtggtgacgccaagggcacaggcttctgctgtctgggctccggcacagtcattggctctgagtcatccgggaaggaaaggcatcttttaccgccccctctcccaccgtggcctcaggctcccaccatgcaggaaatgcctggtctcccacgaatcagaagctataaacaggactggtggcagttcatacagatttggcaaaggacgagaagctgtgggttattggtatcagtgattatagaaggggaaagagttgatatctgaagataggaaaaggggcttctgaggatggtgttagcatgttcaggcacagcattaatctttaagagtcacgaagagccatcagcacagtcatctccctaataagccttgagagtgttgtcaaagacacttctggatataagtaagaaaccattgagactgagttgtatggttaaacagcacagtttttagggagaggcaaaggcaactctgtgttcagctcttagttctgacacttatgaactcagatttaaattccctgagcctcagtttccctgtctgtaaaatcaggataaaaatttcttgctcaaggccaacaaaaacaagcaatggggtaaaggactccttattcataaatggtgctgggatagctggctagccatatgcagaagaatgaaactgaacccttacctttcaccatatacaaaaattaactcaagatggattaaatcgaaatctaagacctcaaactgtaaaaatcctagaagaaaacacaggaaaaacccctcttgacactagccttggcaaaggatttttggctaagtccccaaaagcaattgcaacaaaaacaaaaaattgacaagtgggaactaattaaactaaagagcttctgcacggcaaaagaatcaacagagtaaacagcaacctaccgaatgggagaaaatatttgcaaactgtgcatccaacaaaggtctaatatccagaatctataaggaacttaaatcaagaggcaaaaaaacaataactccattaaaaaatgggcaaagggcatgaacagacacctcttaaaagaagacatacaagcagccaacaaacaagaaaaaatgcttattatcactaatcatcagagaaatgcaaatcaaagccacgacgagatactgtctcacaccagtcagaatgctattatcaaaagtcaaaaaataacagatgctggtgaggctatggagaaaagggaatgcttatacaccggtgggggaaatgtaacttagttcagtcattgtagaaagcagtttggagatttctcaacttaaaacagagctaccattcagcccataaatctcattactgggtgtatatccaaaggaaactagatcattataccaaaaagacatatacacttgtatgtttactgccacgctattcacagtatcaaagacatggaatcaacctaggtgcacatcaacagtggatttgattttgttttaatgtggtacatatacaccatggaatactttgcagccataaaaaggaatgaaatcatgtcctttatagcaacatgggtaaccatgttggaagagctggaaaccataattctaagtgaatgaatgcaggaacagaaaaccaaatgctgcatgttctcacttataagtaggagctatacatcgagcactcatgaacataaacatgggaacaataaacactgtggactactagagggaggagcgggagggggttaatgagtcagaaactacctcttgggtactgtgctcactacctggatgcaagatacccatgtaacaaacctgcacacgtaaaccctatgtctaaagtaaaagttggaaaagaaaaaatatttcctaaattgttctagaattaagcaaggtaatatttataagacatccagcagagggtctggcaccctggcatataatagatgcctaatgaacattagtttccttatttttcttacgagagtaaaatattaagatgtacatattctgttaggtcatagaaagtttgaatggtgggaaaagtcagctgttaaaatgctgtgggatctctttttgagccttttcacctgtgatcaaagttgtccatcaccctggcatttttgagagctgtaatttaaggaagaaggtatcataggttacctctgtggaaattctagaatttgaatattatgcccctgctcacttgtagactgggctgtcactataaagttaggctgacttgactgtatctgataattaggggctgggagagcatggaaaattgaagccatagataatcccagtgtcttgttttagccaataataattcttctcccaccaagtctttatcagaactgctaacaaggagaaaagtcgactggtttgagtttcctcaccttttattctcccctgggtatcttcagtagaggtgctaatgaacagtgaaatggccaaaaggtgagcagctccagggaggagaagaaggaggctcagataatccacaaactgtaatcgctttgaataattgagttaactccagtaaaatgtagagatacattcacctgctaggcattgttggaagctaaattaacacactggaagcaaagctttcttttaagtttcatttttaatctaatggtggacattttggggcactgcagcctattaaatctgctaactgatgttcagacgttatgaaggagttaaactattctaagaatattcaaggcctgttgttctctcctaggctttctacgtcaaagagtaaagtcagaaaagccaaactgatttctcctaaaatgaagagaattgaagttactctcccaaaccccagttgtaggccaggccctaaactgagagaaatggacaacccaaatattttgacctttgcccattgccaggtgaggccagatccggggaggaagtgatgttttcttatctgccttaacttagccactacgtggagaagcactgtaatgtaattaatgcagaggtgctcaaattctggtgttcctcagaatcacctcaggggcttttagaaacagttgctgggccgttctctcagagtttctgatttggtaggactggggtgggacaaagaatttgcaaatctgagaagttcccggttccagggaccgcactttaataaccacaggtgaaaccaatgagaagctgagctccgaagtcagactacctgggcttgaatctcagatctctcacttggtagttgtgtgactgggtagttgatagtttacagaatctctttgtaccctcgttttctcatttgtaaaatgggaatcctaatatctcataggattgtgagtattaaatgaattaatatgtgataagcccttagaacattccctgctctatggcaagtgtgcattgtaggttagtatgacacggttataggctctctgtaacaatgaatatagtgactgatattttttgagcacttactataggccagagattgactcagtactttgcaaggattatcacatttaatacccacaacgcactctccctcctttcccatgtcctgcttgccttctttcttccactttcagttattcctttttcccttccattctttcttgctcttcaaaagccatattgtgacaaaattaatccattctaaatgaaaaagaaaatgtaccttagttataaagtatgacctttgtgagttttttcaggactgttcacctgttctttgccttttattccagcgtggtacccggcacatagtaggagtttggtgaacattaattacttgaatctcgttatccttaaaaatcaaacagggtttatctatcagggttcccttctcttcctttgtcctatcctggcctctccttgaccaacacattggtaaatttggcctctgctctttcttttccccaactgcaggggcccacatgtcaagacaaggtggcatcaccaaccattgagaaagcttttatttcactagcttctacctggaccacccatcaaaaatctttaaaacgagtattccttgggacaaggccaggtgtcattgagagtccccaggaagagcataggagtcctggtctgggagggccggacctacactctcgggggtgcccagaggaagaacagggcctttaaagtcaccctatgttctctgacccgtgcagtggtggcatactccctcccccacccctgacctgagggtgctgtgtgtcagctctcctaactcttggtctcattagggaagctggttgtcaagtactgcccagttacagttggtttaaactctcaactaagggatcgtaagcaggtcagctgcctgagtctccagttactcttgcagctcaggtttccccttgacaggtcctgataggggctacttttgcaccattgatgtggccagggcttacagcaaggtttaaggtttccatgcgcagccttcttggcaggcagctcccagagaaaggagtatggtttgggagaaagctgcaaggcctgttcgtggatccttagtattttgagccgatcacgtggagtgggcctgtgcccatcagtaccaggagactttatacttaggggagaatctgtatgcggtgtgattttcaagggtctatttcctcattgtttctctttgcttgccctatggctgagtattaaatgaacattgaaagtctactatatgccggttactctgctagatactagcagagatggagggtaggatacaaagacaagtaaggcctagtcttcaggaagcctttatttgtgctctgtgtatcagaagagggttgagttggtgacaagaataaagagttgaggggagtgaggggctgaaaaataataagccttagagaactaggaataaagtgttaacttgggaaaattgttgaaacagttccttaagatatttgtagtagatatgtctctagataagaggcttgtctggctgtgaggtccttgcacgagacccttgcaggtttcccaaatctatttggactgggtgtcctgtattaacatgaaatcgtaggcagacactgaataaatcgcaacagagtttcggttgtggctgctccagtgtcttggagtggttgctccagacacataggtcttatcctcctgccctgaggttctccaaatttgcatttgggaagtgtatagttttatgactgtttcttttatcgtgaacttacggccaccccacttccctgcccacttccccatcagcttcaccttgggtcgcggcacatctgttctccagaacatgttccctgccaggaatctgcagggagctcttaagacttatctttctttttagctgttttttttttttttccactcaacttctaggctagtgctgagtacttatatgtcatgctgtgaatatgtgtgtgaatggattggtcagaattccaaattttagttgtaagaaaattcttttgtgcagcgtgcatggctcaaaatgagagaaaagacactgacgaggacttggcagccccgagcttttccttgggatgttatttgctttaataaattttgacctattttgtaacagaccaggttggagttccctttttaacctgctgtttcaacaaagttaagtgcattgaaggtctatctcaaaggcaatatatattttaaaaatttcagaatcctattctgaggctgaattatggctttttcttttcccataggatttacatgtacactcatctgtattacttcagatgttgctgctgtagtttggatgtttctctccccaaacctcatgttgagacctgatctccagtgttggaggtggggcctaatgcaaggtgtgtgggtcatggaagtggatccctcttgagtagattgctgccctccctgtggtggggtgagtgagttctcgctctgttagttctcacagaagcagattgctaaaaagagcctggtacctccccctgcctctctcttgcttcctctcttgccacgtgatctctgcacacgccggctcgcctcactttccgccacgagtggaagcagcctgaggtcctcaccagaagcagatgctagggccatgcttcctgtagcgcctgtagaactgtaagccaaatgaacctcttttctttatgaattccccagcctcagatattccttcctagcagtacaacatgactaagacagttaacttcccatctgactccctccagttgcttcaagggtaggcaagaattgtatattagctatttctacatccagctgtgtatccacagtgcctcttatatttggcctatagtacatactaaagaaatgtttatgtactctagaaatgtactcaagaaatgaccaaatgaatggataacttggctcatgagaattcttaagggcatttgaaatggcaaggggtatgtttggaagaaggagtgtgaggagctgaaggaaaagaggggagaccagctgtgttcagaacccacagtcatttcctcaggaaacagtaccagatatccttggatgtggggaaatgatccactcttgcagtagcctaggccacaggtaattttgtgtacccactatgcacttagctcatacagtaggtcgtaaaaatgaaaatggcatgattccttcataatctaggtggggagacactataaatacacaaataatttaaaagtacagggctgagcaccgtagctcacacctgtaatcccagcacttcgggagggcaaggcaggaggatcgcttgcccccaggagttcaagaccagcctggacaacatagtgaaacttcatccctagaaaaaacaattagccagctgtggggcatgcctagagtcccagctacttgggaggctgaggtgggaggattgcttgagcccaggagttcaaggctgcagtgagccgtgatcacaccactgcactccagcctgggtgacagagccagaccctgtcttaaaagaaaagtacagattatttcaggattaagcatatgagtacttaggctagagagaggcagagaaatgactcctgttttccagccactgtcacactgcagtgtaagccatcgacacacacatacacttcacttcatctgcacagcctttcaagataggtgtttttatctccagtttacaggtgaggaaaccgagctttgggaccaagttacttgtgcaaatcacacagctgggaaatatcattgccaggatttgaatctgagtctgcagcaattcagagaaagggcacgcacagtggcttttgtgtcagggaagagacattgtctgtattgtgggggtaggtgaactacggctggaacaccagcatgcagaggacttgccttttagctctgaggaggtcgcctgcccttgcatatctataaacaaccaccctggattgagagctgttgaatggggagtttgtctgactcccagaagagagcacagtacaggagaaaccttatataacgcagacatgcccggcatcccgcaggcgggcgcaagccaaccgcacacctcacagacccagcttttgttgtgtaggcgctgtggtgtaaaaaccatcctttagggccctctccctcgtggtggcagcgtgcctgggagctttctgttctatttgtggtatctgttccctttgatcattgtgcattgctttgttcctcatctccctctttggtgtcacctgtgaagtcactggagagccataatcatcctaaagaaagactcagagaagaagaagtaagacctaagaaaacagaccctttagcctccttggagctggttttctagttaagaggcttgattaaaagcgtggggggaatggatctgtgacgtacatggtcatgaaaagtgcagccagcgttacagcacacgtctgtataggttgcatcacaggcagggaagaggcctaagggcctggtggcccgcaggtgtgagcccctctggtggctccatgacaggagaccccgcggagaaagtagctcctcttccttttttaaatttttttttatttttattttttactttgagacggagtctctctttgttgcccaggctggagtgcagtggtgcgatctcagctcactccaccctctacctcccgggctcaagcagttctcctgcctcagcctcccgagtagctgggattacagacacgcgccaccacgcctggctaatttttaaaattttagtagagacggggtttcaccatgttggccaggcggttctcgaactcctgacctcaagtgatctgcccgcctcggtcttccaaagtgctgggattataggcatgagccaccgctccccggcctccccttcttataacacttgaggcctgtgcttcagttcatgggccttatgtaaaggcttctgtcacctgtctactccttcttcaagctggctgtttattcggcacagaggagtaaattacaggtggattatgcagtgacaagcacttttatacctcctgtaagaacagtttataccaggggtccccaacccccagaccgcagactagtactgtccgtggccttttaggaactgggccgcacagcaggaggtgagtggcgggcaagtgagcattaccacctgagctccgcctcctgtcagatcagtggcagcattagattctcgtaagagcacgaaccctgttgtgaatgacacatgtgagggatctaggttgtgtgcttcttatgagaatctaatgataaatgtcatgtgcttgaatcatcctgaaagcatccctctgcccccagtccgtggaaaaatgttcttccaccaaaccagtccctggtgccaaaaaggttgaggactgcttgtctatgccttaaaaaaaaaaggtccatttactttgcagtcatagaggacgcagggctggacttgaggaaatctacctagaaatccccttcaggttaagatttatgacattagcttcactattgaattggatcatagacatctataattaaaggaaaccatttacactttattgttcattaaatgtttaaaccacctgaaaagatttttttctaattgagcctttttgcatagttaccagttacccgtatctgacttcaagtctttagccgtatacctacatggttccatagttatcaatgtttatttacaatttaatattcttctttagcattatttaatatcaaaatgataatatgtactacggtaggttgggctttacagcttacaaaacactttgacatacattctctattatttttgatggctctgtgacatactgaactgaagcaacagtttaaggctatttctaaattgggctctgctcaagtgtgagaaagcgtgacagtcaacatgaactagctttagccttatcaccgtttcctgctcaggcaggtaagatctgctgaaggaaggaaccgttgccaactggccaggtgtgccagttcgtggcctagaaggggcagctgtcagttgaactttgcccatgttttcaggattttatctcaactcctgagtagtctcatctgggtgggagcactagaattgaaggcctgttcaaaggttttgtgcctttaactggagaattttttggaagccccttagaactgccaggcagccatgtgggatcaggtgggggggactgggctgctgtgtggtagatttgagttcatgtctcataaatggactctccccgaatctgagagggttgctccctaagtcaactacttaataattaatggaaaggagatgtgacaggaatagccaatttccctgtcctgtttggtatgactgttggcaatttgatgattccttccttaaccttgaagcaatctcagtttgactgactcatactatggggaagatagtggcctttgaactcttgactcaatacagtcttgaccttggttagatactaccttgacctctggataaaactgtactgggcattactattttattgattgttctctcaacaaaacaaccgtatctttaaaaaatttttttatcttacatgtctgaagtagaaggtcacctcttttgtagtgaaaaaataactattttccccatggtgtgctgaatgcatgggttaaagcaggtagaccagctgtcctgggttttatccctatgtgttttttgctgattcacaaaggcatttaatttctctctaccacgctttctaggtctgcaaaatagaaaggggagttcatgaccatctatgcgttactgggggatttttctgtgcaagcgaaaattattgatgcaaccagaggacttgctgccagcgtcgaggggtgcattttactccctctgtaaagaggccagcagtaatgatagaaacacagtgcatttgactctgaccttatatttgacaactcttcctctacaatccttaaaaaacatgcctcaccatttaagagaccagcagcaggccttcagcaaagcccacggtctaggcagcctttgtaggcctctgggattgtggtgagaaaaccttatccctctcttatttcctgataactttacattttagaggtgtctggaaagaaaggtggcagaaaagcagcataacctgcttgacaagtcctgtacaaacagaagtccaatgaggctgctgctctggggttgccaagctcaaggaagccaattgtagtgtgcacaaaggtgcaagtcaccaaggcctcagagagctccaaggaagcctgtgcaaaggcaggatttagagttctaaggacgggttgtccagcgcagcccagcagagaacctaggtccataactgtggactctcctgtgagggagccatgttgcggggtggacatctgacagttgtccctgctctgtgaacctgcgacttcatcctacaggtgcagagaatggttttggcaactctctccaccgcagaatgtgggcggacttctgagctgggtttgattttcctcttttgctttggagtgtacaacaatcaaccctttagagcagaagtagaggaatggaagactttcccatggcccaagacccctcagtgggttgctgtttgctcttccctagaatattataatgttcaatttatgcctccaggagaccagagacacacgtttcccaaatgtgggtacaggtggctttaagctgtttctgtgagtagaggcccagtgacatgttccccagtgtaaccccctccttggtttcacatcccctctacccgattctaggccaagcccctccagtgtagttggtgacccagaacaggtgaaagtgaggctgccttttgtagcactgctctttgtgaatgggaagtgctgctggggagaaatgattttaagtgtgagctttgctgttaggggcagccctctttctccactgcaataagaagagtcatgactaagtctagaaaggcaggttttgatctttaggatactgtgatgtatgaaataaaggtatgtccttcttattcggtgttgcattgtcagcacctaacacagtgtttaattaaagcaaaaatttttgtattgaaaatataactaggtggaggagtaagtcagtgctacttaagtgtgagtatttgtcttccctgatcagatggttttctacgtactcaaaatttcatgtagtaagaatgcaggatgcttatggagaaaagtgagtgttgtttgtttctccttaatatttatatataaaagcaagagcttattaaacttttagacgtctttggaggtttgaaatttcccactgttattcttaagaagagaagagaaagaataattttttttcttctgtcttattggcctttaaggaaaagcgaatttcagaaaaacatgggacggaacaggaagtgtttacaggtttagtcatacttgttaggtatgaaaaagccccactgccttctcatattgtttcttttatgaacttaacacttcctactttgagaataccttcctccccaagggctcaaagcccttcatagtcattaatttgcatcttgctaattttcttaaaaaattaaaatgttaactaccatttagctggtattctaccagctaaaacttccagctaaatgcattttgtctgtctgtatgtattagctcagttgaaaatgtgatcctactgaaggcagtagggtaaccggcttgtcccagtttccctgggatttcagttttagtactgaaaaccccacatccccggaaccccttcagtcccagacaaaccagcatggttgggtcacccaagaaggcgaccagttcaggtagctctgcataaagagaagatgttccaccctgcagtccttaccttaaatctaggcagctaccttaagaattgacctagacagcagtgtgtgcatggctcagtgcaaatctttagcatcacctggtagaagacaacactgagcacacagtcgcagaactagtgcagttcgaggtacgtggaaatgtctctgcaaagtaatatttctggtttcttgtttttttgtctacccttttcccctttactgcactatatggtgaaaaacgaaaacaagaactgctaactacctgatttccgaaacaagaagtgtgatctcaaatatttctgttgatctcaggtttttcatctgaaaaatgaggatgctggtctcaatttctaaggccccttcctgcccaaacttaccaggaggaaagaagctggaagtagaaagcaggagaggttcaaaaagaaaatgggatgcatctcctttagtaagctctactctggagaaggacgttgtccttcaagtacaaaccttttcaccgacttggggagtttccccccattgtatcccaccccatctttttctgccatcgtgcactgtgtcgtttgaatgtgctgctttgtcagggctgggggcttccttggtgctccagcttggccacatccgacacacagaccaccccgtcctccttctgcctctagaggaccaagaacaacccttgttctgaaagcaccctgtccctgagcctgaacacatgaccctggatgtcagaagatgctcttctccatttcaattgcccaattccagctctgtaatcattatgttaaatgatacaagtttcaaaaaatatatatttctaatagactttctattatcttccttaaatccacagtgtcactttcattcttactcctcattttggggtgaaagtgtagaaagattgtggctttagaatctgacgtactttgcttcaaattctagcaccactgtgtgacattgggaagcccgttctttaaccccactcagactctgtttctccattgatgaaatagaaacatacagtatcttatgtgtctggcacatggaaggtactcagcatattaatattaaccactttgggctgggcgcagtggctcacgcctgtaattgcagcactttgggaggccaaagcaggcggatcatgaggtcaggagattgagactatcctggttaacacagtgaaaccctgtctctactaaaaatacaaaaatttagccaggcatggtggcaggtgcctgtagtcccagctgctcgggaggctgaggcaggagaatggcgtgaatccgggaggcagagcttgcagtgagccgagatcgcaccactgcagtgcagcctgggagacagagcgagactccatctcaaaaaaaaaaaaaaaaaaaaaaaaattaaccacttcattcttcttagcccttcaagcccccgcaccgtgttttctgacatatcatcttgttttcatcctttctcttcggtttaattccagagggtacagagaaggtgtaagttacaggtaaaggagagtaagtgcactgtgagtgggtgctgatgaaatatcacaacaggttctcattctgacaactcacactaggccatgcttccccggaatatttatggaactaagtggaaaaaaggatctttagcaaggatccagcaccctcaatgcagggaatgaaatgtgtttattattagagcaatccagtttccatacagctaccaatatacacacacccacataccctgttcagccatactgaagagtttacttgtaaatccaggcgaagctgatgctgagaggtggcccgctgtactgattttgtaaaaccagcaggaaaacctctgctcggccgaccacttgatgttttagttgcagccactaacatgttaatcaaaagaagcaaatacatgtttttcccttgagaaaacatggatagtggtgtaacggaaattaccttgaattattcctcctcaagtatctatccaatctagatagatggattatctgattgcaccaggagatgcagacctggcagtggctacttctattgcagcatctttaaaggaatcagatctttggatttccattttcccatttttattcttattttctccctgctaaaaaacagtttgcagaggcacttgaaagtgatataaactccatagtagataatagttgtacatgaacatcgtatcttttatcatatagtcccctatgtaattaggtgatagcttgagcctagcacaggtggcgctgctgagccatctcggaaatgaccacatctgaactgggcgcagtggttcatgcctgtaatccccacacttcgggaggccaagatgggtggattgcttgagctcaggagttcgagaccagcctgggcaacatgacgaaacctcgtctctacaaaaaatataaaaattagctgtgtgtggtggtgctcacctgtggtcccagctacctggggggctgagatgagcaaaaaaaaaaaagaaaaaaaaaaaaagaagaagaagaaattaccatatctgtatgtctatacataggtatgtggatttatcacagtgctggtacaagtacttttgtcattgatgtttattaagctttttatgctccaggcactatgcaaaattgtagggcattatctcctctaatcctcagaatcttatgcagtagggccggtgttgctattactccattttatagatgaggaaacttaggcttggggtgtttaagtaacttctatgaagtcacacagtaagtgctagagccaagaggcaaagtaagcctggatgcttccaagccgtagctcttaaccactatgctatactgctcaaaaatatttttagaactgaatgaagacatctaaggaaaaggaaaacgtggtccctaatggtcttttgtgataacaatatgaaacctttcgtctctaaagtgtcatggaagtgaaacttgaaaggctctgttcttcatcttctacttattaatgggcaaaatgtcttcgtaatttatggcatgtgtcccaaaggtgcaaaggtggcaaggtggccttttttttttttttttttttttttttactaatactaggtcctgcttccaagcctcctatttcttcacttccctgtgtaccagggtttacctgctgcttaacccacccaccccactatacgtgtctgtagtagacccaccaacattcacatggccacttctgctgaaagtacctcccaggatagaatagggtcacagacccccaattgtataagcctttggcttcttgatgtctctgcgagttacggttatgggagttggtctttggtgagattagtggtgagatcagtgggtggcacctagggtgatttattgaatagtatggggtgaggctgaagagcaaacatccacgtaagtgttgtctgttttggagtttgaaaagttgtcaccctaataaacaaactacttaattgaacagcccttgcttggcgtgatcaaagaaaagacctagactttgctatcagtaggctctgggttccaggcctggcttgtcacttacgatgatgatgatgatgatgattttttatttttttgagatggagtttcactcttgttgcccaggctggagtgcaatggcacaatctcggctcgccacaacctccgcctcccgggttcaagcgattctcgtctcagcctcttgagtagctgggattacaggcgcccgccagtacgcctggctaatttttggtatttttagtagaaacggggtttcaccatgttgcccagactggtctcgaactcctgacctcaggtgatccacccgccttggcctcccaaagtgcggggattacaggcgtgaaccatcgcgcccggccagctcgtcgcttattatgcaagttgtataacattgctgaatcccaagtttttagtctttaaaatgagaatttaaatgtcgcccttattttgattgctgggaagtttaaatgaaacagtgtatgtgcctgtcacatagtagttgacaataaatgatagtttcttttccttttcccttaagtaagttttttttccctctagcctataagctccttaaagaagatagagattttcttttctcactcatttccatattctcagcccttagcagtgccaggcacatatttgctgaatgaaagaaaaatcttttacaaaggtcttcagatcattcattcaccagacaattgttgagtatctacagtgtatcaggcactgttcttggagcagggcagtcttaaaaaacacacacaaacatagtctgtgtccccttttttagtctaactgggagagaaacattacatagataattagagcaatgaacaactttgatccttgagatgggatttaaattttaagagataggtgacatttggtgtcaagtctgtccaggtatacttgatattgtttttgatcaggtacaagaaacggcaatatactgttatctataactggttctgaaagatctgaaagaggtgtttctaaagtatttttgaggaatggtgctgcttttttggaataagtataaatacattgtaaagtatctatttcgagagggaacagacttgatgggatgggatcatagtaggtaaggtgttccaggaacttggaacatactggaataaggcttaaacacaagtcacagaactgggtgatagggcggtgagcgcatctactggagaggagatggggcagggctggcagcttgtagcaagatttttatgtagacagttagacttcaaacttcatcagtaagtcagtagatggccctaggtggaaacacaggacaaaagatgaatttgtgttggcactagaaatactttgagctcatctaatgaggctcattcattcatttggtaaatacttcacgagtgtccagtgcaagctctgttctagttgtaagggatatggcagtgaacaaggcagacaaggtccctgtgcctgcagagttttgatgataaccttcccccctgggtgtgtgggagggcctggggctcctgtgtggtttgggggtctgagaggtggatgaaggtacagtaggcccacagtcgtggaaatcaaagtccaagctccagtgaaccatcaattaagaaacaagggattgtgaagaacaagacctagatccagactgaagggaaggatttgctgaggagttcaggccagcatgggctggggtgacttggcctggaactctacaacagtcaggacagggagtcctgaataggggcacctgcagctgagtccatggatggggagggacctgtgtaaggcactgaatttagactctgcacgcagttctaagaggtgttctcaacacgtttatgcaactaaaaagtgtttattaacagtgttttgaaacaagtgggatttttgttgaggttgtaggataattcagggtcatatggagatttttattctatcagtatttgccctgtcatgtagatgagacacgttagaggcaagcctctgaaaattagattgatttatttttctagtctgaaccgaggaaaataactacttgtcttctatctcctggtgctctaatatatgtaaaatgttgtcttatggtgagacaatgcatattaattttttaggcacttgatggaagaagtggatgagggaagcagcatcggtctttgaacctaggtcagaaagaaatggaagccatggtgtgagaataatgcatcatggtttgtatggcctttttcatgtattttaactcaactgattttctcagggcctcatcagtcagtcaacgcagttttctccatctcatagccaaggagactgagactcagatctgcccctgcccactttttttgtagttttagggggaagcataaatgtggaggaagtaaatgagtgtgtttgttcaggcttagacttttgttattttttagccttgcagggaaggggaggaaagccaataacgatggctagaattggagatagaatgaatgcaagttgcattaaactgtaaggttagtctcggtaagaggttgtttatatggtggtgtcttgggtgtatcttaccatgtagcattcttcgttttaagaaggattccttccggtgcaacatcagtcacagcatagaaagcctatgctgctctgctagtttgcttgcttgcttgcttgcttgcttgctttctccttccttccttccttccttccctccctccctccttccctccttccctccttccttcctctctctttctctttctctctctctctgttttttgtttgtttttgctttttttttttttttttttttaaatttgagacagggtcttgctcagtcagccaggctggagtgcagtggcgcagtcatggctcaccagccttgcacttcttgggctcaagtgatcctcccacctcagcctcccaagtagctggaatgtaccaccatgcccgactaatttttaattttttttaatggagacggttttgccctgttgcccagactcatctcaaactcctgggctcaagtgatcctcctgcctctgcctcccaaagtgctgagattacaagtgtgacccactgcgcctctgccctgtgccacttttccacagctgctttacctacagcctgggagtcaggccagcaaatgacgacaccccaggcacagacatgctctctaggaacttcgagtcaggtatttcactttgtaaagaacttccattttaattctattttctcctagttagagactcatctttcttctgaggggtgcaaatgattctttggagaagtttaaacctgttttacggttcaaactcaagatggtagaaacaagtcatatccaaaagagtgccccgagctctaagagttgtggctgcgcaacgttttttaggtgtctccgaagtgttatggccaagttcaggattgacccagatgaggagaggttgcactgcatagtgatgatttgtgttggggaggagagctgaaactttgcaaagtggcgtcctgaaccaacttgtttttcagcttctagggaaatttgttaggtaatttttaaaaaaagagagagagagacagagaagacttaatttgatggagcctaaactccactgtcttctttctgctgagtgctaaggggctcatggtctctgaggacagagggcaggaaaacaccttcatgccctgtgtcctctgtaaggggcctctagtatgagggactctgatgactattgctgttggggaaaagaaggaaaaggaacaggggtcaacttctgtcatcatctctccagagtttatgatgtttctgaaaggatggggaatagtgcgtggcccccactcatccctgtgaggtgctgcccaggtatccaacctgcagtgcacatgctcgccactggcactggggatggtgagtgcagcagagagatgggattcttaatttattcaattttaattaaaaaacacagttcagttgttaaaaacctatttaagtgtgtttggaatagcttggatatgtgaatttaccttttcaactgtgaattttatgaactctaaatacagatcaagtatttccagcaaaaatttagtgtcggatttgaaatgtgctctaatggaaactagacaccagatttcgaagacttagtatgaaaaaaacataaaatacctcagtaattatctgtattgactatacattgaaagaatattttggccacattgagttaggtgtcctatgttatttagatgcattttacccatctcttgtttttcatgtagctaccagaaaatgttaaattacctatggggctccccttatatttctgtgggacagtgcgagtctagacagtgccttacgggatccatcagaagcattattggactttctagggaaagttgctggacttcaaaagttagagtcataatttttcccgttgtgttaacaagttgctttatgtggatgggtttatgacaattgagggttggaaaataggttttaataagagtaagttaattgagaggacagctttacctctgttaatcagaatgattttaaaatgcattttcacccactcagaaaccactgattctcatgggaacaaaaaactacattcgtgcgtagtacgaatttgtgcctgctgggtccttgtacctttacgccaggcagaaatctccgtaatcgtcagtgtagatttcatttccttgtggcaaggaatataaagtaatacaaccaaaggggaattccactgcatgaaaggaaatattagtgctcgtctagctcttgtttcaaccctataagctccaagtgattttcagagtccctccttcaacttttttgttaaactttccagattttcctatttatagatttcagttgttggcagctacatgttggaaccgttgttgaagcccctagtaagacttgatgctgtagcacgctttcacagcttggtttgcaagttgctttctaaagatgcaaagagaattactacccactctagtagtttgaacaacccagtgaatttcagatattaaagccatattcatgccactgttctcctaattctatcactgtttagaattgcattttgtctaaaggaaggatagatagaatactactaataatatcaagatgctcagaaactgttgagaattttttttacaggaagaacttaaatttccagaggcttttaaaaaaaaatttattaaggaaggagtaaataaatacgccgggttcttgagtaaactacttttacccttcagaaccactttgtacgtagactttatcatgatggccaagagtttttaaaatactataggcagagggtatactctagagaaagaagacaacattgggtttaggactgctagccccatccagagcagttatgtggttcattcagggatcttcttagcccttcaacctcaatttctacatctgtgaggtaggttttgtgctagttctagtgacatgactcgtgggtgtattaggaggatatagcagcatgtaattgaagggcttttatcttggaaaagccttagtaggctcaaggtttctagttgtttagggttctaagattttactaactagtcagctgcttggagttcaaggcatttcttcagattataatgagttgatagtgcagtgtgcaaaaataaagaccgaaccatggtaagtagcaaggttactgtaaggaaaaaaatgtgtcccactggcccctttaaaatggcacaggtgcatctctgtagcaaccttgacagccatcatgtgggatcattcccctcacccagggaacagtggttccccaatctccaatctctccattctccagcatgagaaagtggtctggagcttgatcacatgaagatggacagacacagccttttggatgcgagagagggaagggaatgcaggccaaaagtggggtgggttttcctttcctcttccttgttttttattaaccttgtcttgctcctgccacacacaagtgcagccagtgctcaggacactgctccgtgtggagctccggaaagtgaagctgagaagccttccttggggtggacatggggggagctgcagaggcaatagggagaaaataacaaccatggctcaggcactgcttggagcagttgttcatatgtaggtcaggtagtcatcattcaggaacttcctgtattacacaaataatctctattttatggttaaaggtaggacagtgataatttactcaggagggaaggacaattagcaaattgattaataaggtttctaaaacctattgtgaaagagaatcctttaacatatgtcttgatttattctgcttatttatgtcttgatttaagacagtgattcgcaactttagctctgcatattgcaatcacctgggagctttaacagcgttcatgcctggctcccatccctggagatttacttggctattgggattgtgttttaaagtttctccaggtgattctaatacacagataatagccagaatgcctgatttaaaatgtttcctgaattgttagctgatcttgagtgcatattttctatgtactgttgcacactaatagttttaatgaaggcacagaatcttatgtaaaataaactgttaattggtcttaactacagggctacaagagtttccttcttatttcaagctgcttaatattccgttaatcactgttgtcatgcacacacacttctgtattccattctcattcatttactttttagaatggtattaatgctggtggcatttgcagggtagtagtcaccttgtcagtagaacttgctttagtaattagttgtcagaaacaaaactccccagactttctacccatgaccacaatgaagggaatgatgccttttctgagtccctattcctaagaatcaggaaatttctatgatatttgacaagtataggtagaaattacttgccaaggtgattatgacttctggaaaaaatttttttaaaggaaacacaggtgtgtaacactcctaatcagtatataagattgtttgtatgttactttttcgagttataaaaggaagaggataaattctgcctccttccccagttactgtcaatcttcagtcttcttttgaattaagttagtttcccattttacaacataaagacaagtttaattcttaaggcttacataaaaaagtaatgtttaatttgggatttctcaaattcttcatcataataacaccttgcattagtagagaacctttgttgcaagaagatcaaaatattttataagcttcatctcatttttcttttctttctttcttttttttttttttttttggagacagcatcttgctctgtcgccctggctggagtgcagtagcacaatcacagctcactgtagcctcaacctcctgggctcaagtgatccttccacctcagcctcccaagtagctggaaccacaggcacatgccaccatgcctggctaatttttcatattttttgtagagacggggtttcgccatgttgcccaggctggtctcgaactactgagctcgagggatcctcttgccctggcctcccaaagtattgggattacaggtgtgagccactgcgccagacctcttttatctttgagataataccgtgtgacgacaaaggctgggtattgttatccgaatctctcacacagcaacactgaggagacattgactcatttcttttacgttgctttttaagtacagtattgtttggttttgttgaaaattattttggtagtaaacattttccagagatataaatcttttccagactcatttgcgcttgttactgtaggtagaattcatgaggcttttcctatttctgtttatttcggagcctgaagtgacccaggaattatgtgatatatgtagagcgagggaatttcttcagtttgactgtggtcctggttgtaacccagccttcttccttacagatgggggtgagggttggggtatcccttagagcctggtgtgtcttcatacaaacagctttgctggggctgcctagagcctgggccagcagtggggtagtatcaagtacagggcattattcagcggttctccacactctcctcatttgaatgagaatataaatcttctcccctggctctcatgtcacatctttaaaacctcaagtttcttattaggcatgtgtggtccatttaagctctagacatttcgaaaagataaatcacagggcaaaacatctttctagttttgaaggaggtctgagttgcagctcgctggggttgtgagtctgagccgtcgcttttctttctcttccttttacaagacttccaggatatagccgttaaagaaggacacaaaaaagagcaaagccctcagtgatgctgtggcacaaagaagaaagctacttgaggaggaggcgaagggtttacgaagaggcaaagaatgcaggtgaagggagggaggagttaatagttaaggctcaggttccaagccctttgggctgccagtgtctgcaggagccttgctttcatcctttccttctgcccaggttttaagtctcatgagttaaaacctggggaagctcccaccccaggtccactgtgagggaacgtacaagaacagtcacgtggcaatagtacatgcctggaaggtatctctcatttggggggagattgagaagcgctgtctaatggtgcccttgatacaactaaatagcaactgtctcagttcattacttgttagccccaggcagggacaacgcagattggctaattataatagccagaccattaaagggaatagcattaatggaggagaaagcagctaataaagagctgaacttggccactttgttgtgcccaggatacaagctgctgttaatttcagtacctgtttcttctgctgttagaactaggaagaaaggatttagtgaccctctttcaaaaggtggatcacaagcttagaggcattgctggataaattcaacagcaagactttatttcttccccagaggtgacgtctgatggttctgtataaataaagtcacaccacctttcttatgctgaattgatgctgctgacctgctgttagtaggacatgcacttttatggcgtttccaggagtggtgatgtgtgttgctgagctcatctaatctctgctttgagcaaaggcaatcctctatatcatggcagggattagaggtatagcctggggctgcagaatggtgtgatttaaattttcccatgcaggttcaaagcttgtaactttgcctgcgtgtacatccacactgggttccagccacatgaactgggccaccttcatagacctccctggtaaccacagcctgacgtgacaaggaatcacagttttactttccgcttactatccatgttagaaatatctaaggaaattcaggaaaaaaaaaaaagagagaatttcatggcatgtcaagaatggaaagtatcttaattaaaatgttttaaaatgggaacaataaagaagtcgatttaagttttttgctttggtgcttgtctttaaagaaattgctcctaattctagaaactagtgctttttctaattatattcagtagaaccctaggatcctgtgaggaggcataggggagtaattgataaagaaggggactgtggtgtccgtgttttatttggagctgttctacccacactgtaatttataagctctaacttaccaggggagataagattgtatagaaccagcatcttgcagttatacggaacctttaagttctcctactccagctccttcccagtgcaagcacgtgttttagagtaactgttcagcctcagcattaagtcagctttaggagaacagtaaatcgcccatttatctggagacttcagctgtttgaaaggccttccttctagtgcatcggtatctgttgctggctctgtcctctgctactacaagcaagccttgagtctctcttagacttgtccttcctatatttgaagacatctccgagaagattttaaatcttttttcccccacaggccacatatatccttaatgccttcatccattcccctcttgggaatgtgcatctttgggccattggagaggtcttgcttggactgcggccactgtgatttctgggggcagactcagctccttcttggtgtagagatctgcccactataggcaccaaatagatgttggcaggcttctttcctccttactgcttctatttatctcacctgtacttttagatttgctgctcttgggtaagcagataagaacaagggaaatgtcttccgttgttgttaaagacaatgttaggatagaaagtaatatgtttgtactcaaaaatgcccagtgagatttctagccacggccaagttatcatttgcataagcaacctggaaatgccctcttggtcctactgattgtgtcccatggttaatgtagatccctggataaattcgaatggctactcctgctcaggggtcatgccatgagaacttttctcatacatcagatagagtccccttccgtcagctgaatgcatttacccctcagtctgtgctacccataggataagcaacatgcataagaaggtaggtgccttggcttaggcagctctgttgagtcaccctcaagaatcctgctggaattctgtgaggagtgaggatgcagagcaacgaaatattcgaaggctgctatgatttttacaagcttgaacctgtctcttggaattccccattgtgaagtcattgttgactggttggcattataaagcagttcagagaagtaaagttagatcagtctgcacgcaaataccagccacaccatctcccaagctagtgactggaactgcggttttcaagtcagtttcctcattgcggaatggagataacgatgccttccttgcagggtcattgtgaggctgaaataaaataaaggcttcatgggaacacataccacatgctcacttaatgctagctctctttcctgattgtggcagtgactgtattttccagctacaattgtgacacgtgttctgagaggtgttaagtatttatatacaactacccatatgtatttatgggtaaaaggacacggaactttaaatattgagaccatcctggaaattctaggatgtatgattgcataatttgtaatgcctgctataggcctagcctcatagttgacccttgatggatgctgaaatatttcttaatcatagggagaaaaaaaactcaatgaccttttacagagatgtttgattgcagggcttattgctaatgctctctctctctctttttttttttttttttttttttaatctcactatgcaaagataatacaggtctgggtaagaggaagacttaagatgctttgacttaattgtatctgcttgacagaagcaatatactgccttctgattttaggatgtaaccatccagaaaggcagaagaaagggacaatttcagttctaaacaggaatccgaatatctcacgtcctgaaccatctacataaactagagaaagggcactccttaagactggtgaagcgggctccttggaagatccccacagcaacattgagtttggtttgtctggcgtaccctctccccaagggctgagtgggccatctgggtaacctagagaggagacttcagatgctaggagtatagttcctacccatcctcattttcacagggtacactcatttttttccccttggaagtactgatatgtattctgcaagatgaatgttgagacccaaacaccatttggcttgtaaaaattaatggcttagcatccagagggatgttgctttcagggcaggggggacactggacaccaagaagaaagccagcttgggcccctataccatcttggatgtctaaaccatcttctggtaactctctggatgaaaagaaatcatgaacttcacttctgtgatttggtggatgtggattttgctacatcaaaatttgcatttgagtctctgtggtgttctttctagccgagatgctagggtatgctctttctttctggggagattccaaaaatgttactctctgtggctgtgtgtacaatgtctatttagaaaagaagactggcatttgcatcttctctcaaattctttacgtttgtctcactgaattttggagtggacaaaatattcaatagcttttttcaagtgaaaaaaatgtcgactttcaagagtgtattactttaggttcttgtgtatatctgtgctttcctggtggcagaaacctagaaaactctagagctcaaatttcagcgtattcaattttttgttaatgtgtctatagcttgttaataaaagcttacttaatgaaagccaacatcaccaccacttgaaatttttgcagccagaagagtgtacttaaatacttgtgtattcagacttcactttaataaatttcaataaatagcttcccataggagaggtttcttctgttgaatctgtagaagttgacgacggtacaagcatcagctttctcaggcagcttttctaaacacctgcagggtggaaaagagatccttctctcaaaatactgaatattgctggcatgaccactcttgtcactggtgcctgctgttttccatcttatctgggttgcaggtttcttcacagtgatgggacaccgaagtgcaatgggatgaaagcatgcctgtggcatttttaccctagctgtggggaaatgaccactatcctgtgtccatgacactcttcctcctcaggactttcaaactaggcttcagaagccatcactgggggcagtcctggcatttataatggggatagggacaatttccaggaaaagtttctatatcaaggacatctcagttctgcagcagagaaatctttgaaattacctgcaaaccatctttttgcaagcacaaccaactttatttctgttttaattaattccaaaaatgctttatttccagaatgttaatatttagttagcagtaggctctaagtttcccaacccctcagccttttcagagggtataataataaatgtgtaaatgtgctaggggatccccgtgatttatggaagctttatattgaataattttgaagaggaaagaccttttggtaataatattcattttttgactcttctgtaatatgcaacctgagggtgggtgtgggggaacgtggagaaatgccattctcctactgagcacagactgtatacacctattttacagggaagtcacgggctcctaagcattcagtttaaaaatgagcagaattagatgggtacccttcattggcccttcatggctaggggagaaatgggagagggaacgcagctcattttggcttcagtccttacgctttcaagagacaaccctactccatacttcattattttttttaaagctttctataatggttggtgaaatttacatttcaactcttgcctacaacagttttctgccttattttctcttcccagcgctttgtgccgcctccttgacaacctgctcataggtattacaattggcctcagaaattgcagtgcttcccttttgttcagctggttggcttgataggttgtatctgcaaatttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgttaaaagaaagaaagcagctctggttttcatctgtctgacaatttgctttagaggtgggactctcaccaccaccccctcctttgttggggtcgcaccagagaagcagttgtgagagtaaagaggttccctttatttgggaaattagacgttagtgtccttaaacttctctgtctagatgtctccatctgagatagtggtatttggttaatttttccaattgctgatagtctgctgatgtgccagggtagatgttaagtgcgaggttattgcaatagagtgaaaaatgagcactgtgagagtcaacctagagattcacaaaaagagagacaaaaggagtctctgtagtgtgggattcccaagagtgtgttttgttctccttggaacagagcccactcactgtacagcatccttttggggtccccaagtgctctgcagccaccaagcccagagttaccttaggtgtgccatggctactagaagagtgctcggggccctagaagcacattgtgcatttgtccgtcttggtcaaggtaacctctcttgttgctgacaagtctcttcattgagcctttgaaaaagagcttatggtgtggaaaactgtcctccagctgagtagaaaccatcatcaggaatgtgaggagatcagtgggccacagtctcttcatctctggccttccttttataagttttcatcatgaaatagcagttgtctccatctaaaattgtttggacggggtttgcgggggatggcgtcagatcccagagcaggtgcagaagtgtggtgtttcaccgtaaggtcagggaaccatgtagaagtgaaagcacaccaaggggttacttttaaagagagcacagttgaaaggaaggtccaaagcaatgataatttagtaaattacagtatatacactttcagggtaatagctagccagactcttttgtcagctggctggggatggagttcctaagaaatgaagtccagtcagcatggagggccgggtttctcccagcttgccttggtggagttggggcaggcggggatgaggcggcctcactctcatggactagccagagtgtcttgtgagtttctctttgcttcaagggaaagaagagtcattgaatttcgaaatgctgtcttgtttttttcttgcactcatgaagcaccatttgaagaccctttggctgcccgatgttttcttcaccaagtttcacttctgcaaaaaccctaacaaaacagaaagctatttccgagaataaagttaacggtagatatctagacatatagtgggatttggggggtgtcagacaagagttgaagagtatggagaatttgttaaattctaaaaacagactgtttgaaatgctcagaagcccacctcacctttaaaaacctctgaacagattttatgtttcctatatgtgtgggctttttttttttttttttttttttttgcttttttcatcccaaaccaaacaccaaaaagtataacccatccttcaagttaaagtttctcaaaatacatgtgatgcctgctaaagttcaagaaaagtgcagttgaaagttttgcctctgggtgactttttacaggacatcttaattgacccagaaatgaaacctgggatatatgtgcctgcccttcattaagaaattcaccaagaaacctcaggatgtatgtttaaacagaaatattccaactgccctacttgcttctggtgggtgccttagggaaggtatagcaattccattcggaaattataacaatatgtatatattcatttaaaatcaaaacttcctaccacaactgccagactttctaggctatgagcagaggagaagctttaatttggttataggccgaggactccgccgcttccctttgcacatttgatgagatgtaaaatgttaaagaactatctttccaaaacgtaaacactgccttccctttacttaaatgtacgattttcttttgctcttgagttttattttcatagtggcatcttactggtctttcctttccaccatatttttggatgttgtgtgttccattttacattgcccagttaaaccacagacactcctgaagtcatgtttacatgtggactgcaagtcaacctagttggcatgttgatctaagctacaaattgcactgctgttttgccgaacccaacagtcggtttcttgccattatttgcggtattttaacttaaaactcacggtaatccttctcaccccatctagtttgttttaattgatctaacaaacactgcttgtttgaattcaaatggaggatccatggaagctctcccaccccaccctttgatacttgataaggggtcaaacagtacttcttttaaattcagataattctttgaatgaactatgaaatacttcagagggaaaggaaatatcgattctgagatggagagtaaaagaacaaggagatattcattattgttgcagataattcctagcaatgaaggaaaaaattagacgttggatatttttggttgtggtggttgtatagtgagataggtggacaatagaaaaatcttccttgtggattgaagttctaaatctagaacttatctttgaagctgtcactttacttgatcagctcactatggaagtgaatctagaatcatactttgattagaagctggggatattgctacagaagagaaaacatggctttaatatagtgatggcattaattatgtgacttgggcaagtcattttttaaaaagttgtctttaagccattctcgcggacgtattttttttgttcccttttgtccctcctttttacttgtacaaaccacagggtgtacacctattgacatgagtccaaagtaaaggctgttttcaacgatggcagagttttgttatatagccccaaggctaggcatctgaaagacaactgtatacagtgtctctacggagagagtaagccggattgcttgggaagctggtactgcccatgccccgcctcccttttgctccccaccccgagatggtctcatacctccattccaagctttcattgtctctctccccctcccctcttcctgcccttatttttaacagcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctctgaggtggttttcacaggacttcgccacgctgctttggaatctttcacacccccctacccccagatacctttgaaaaatttgaggttcctgttccttgtttctcagtgtattcatttcttccctgactatgacatgttaaaaaaaaaagaaacctggaaacatgcagtatatggcagagccaactaaatctcctagtagacaagatgatttctgtgtgtgtgcaaagtttatctgtattctcaaattcacgcttactcaactttaatattttctttggtcctaaattttgctcagtttgtgagtcagactcacttctgctttgtttttaagctgtgcgctcgtcctttctttccagggccctccctcccctccctgtctgtgctggctacttttcttcccttcgttttctaggcctgcataggtcctctctcttgcctcctctttccttcacctccactctctcttgcttctcttgtgcttgctttgcctcagcagctgcagtctgtagtggttccacctttctctcccaaatcatctctaccccttggcctaccacttccccgtctcagtcctcagctgcaacttggcagaggtttggggcccacacacctgtgctgctgatactggcctccaaagccgttgacacctgctgtgtcctttttgtctgcctttctcatactgccacccagctcaggtgataaaacaggattggggcagctggagagactgaatcacctgattcccaccctcttcacagtgtccaagaaaatgccagcttctctgccttgaatgttatcctgagggcacaagactagcttatagaggacacttgaggtcaccttggcccttccagtgacttaaatggtggcacagtcttgctcaccatctctctccagcagggtgatgctctccagttcttctcctcctgttccaccctcctcagaaggttgctttctgaatgcagagaacaggagacagaggatgcaggttcttcctttctctctctggtaattcagggaatcagatgactgtgatatgggggctcctgggggaacactgccgccggcttatgccttctgccccagagggcagacggttgctgggatgtttgtgaggagttggaggcatgagaatcctttccctcctgcagcttgctgcgtccatcagtatttacgaagttgctgcctactatggtcaagacatttctgcttcatttgggcagggaagtaaaggacacagccctactctaccatcttttcctctacttttaaggaggttcgaactgtaaaggtgccagggtcatggctgggaacatcagtgttcttaggaaactggaatgttgtggcaccatgggagcagacacaactggaaaagaaacagcagccaagtgataggaaattttcctccagaagtcatcctgtgaccgatatattcacttcagaaatattcgcctcaggatggaacatactcatgccacacaggcagaacacttctgctacctaattcattcatttattcatctcacaaatagttattgattgcctctgctgtgcccggcactcttctgtgtcctgggggtgcagaaatgaacaaagcagaaaaaactcccctgctcttgtggaacttaaattctagcacagagaaaaaaaaagtatcaaacactcatcacaaacaggctgagatttctttcataacgttttattcctatagattgcaacatcccccaaggaggccctcgctcctggttcacttctggatgccttgacatatggaagctccttaactatcttccacgagatgttatcctgacaaaacaaataagaaagcaaacaaacacactgaactggaggtcaggagatcttaacttttagctagttctgctgttcgactgtgggtaatttaactcagttctcctagcatacaatactgtgtgttgacaagaaaatgtttaacagccttcctaactttaaagtactatgattctcatctgaggcatcattctccttgctttgaattgtttcttccatactaacacttgaattttttcttgagtagacagtttccttattgagccgtgtctgtgctgcttaccagcattttggtagtgccttctgtgtgcctagcacacaaccataatagctaatatttatcacgggattaccctgtagcaggcactgtgtgaagtcctttacaggaattcttttaattcattctcacaatacctgtcaggtaggtcttctttctatctccatgtcacacataagggcttagacaatttaagtaatttttcaaggtcgatcacagaaccagtaagagatagagtcaaggctcaaactcagttctggctgactccagagcctaggatcttatatccactataccaccaaaaagtgtgtgtttagtaaatatttattggatggatggatggatggatgaattcagggttgacacttagccagtgttcactggtgtggccgtagcattggtttatggctggaatctattctaattgctgttctgtctgttctatctgttgttgaatggcttgcatatcacccttcgaaggatggatgggtccccacgtagacagctataaaatatagaactgcagcacattcccggaaacctttccatttcatcagtagttagactatggattcagattatggtaatgattttgcctgaatgcctactctatggcagtctaactttatatacctctccttggtagtctgcatgagacctattgtgacaccattggttctgacatctgtattgaatcctctggaagtggaggttcccaggctcttgctgtttgccctcagctgggactttccaaatgaggctgagcttctgtcctcccgctcccgtttcagggttctgctgcttgtcatcctgtttgagaggagcatatagcccctacgatgactgaagctgtgccacacacttaaagatgcatcccagctgagtttccaaacctaaaagaaaataaatattctaaccagggaattgggttattgctgttttaatctgggattccagacaattcccagtggaatgctcatggaaagtacggggaagaatctcaaagccaagacaacagcgggacatttatggtattgctaagtccaaggcacttgtagctgcttattttaaagagatactcatcagattggtatgcctcaaagtgggttcttttcaccattttccattgattaccagataaatcctctcccttaattcttcctttctcttctttcattcttaaatcaacttatattcttgtggatgggggtaaagaggagcagagatcatattatttaaggttctcatacagagagtttctcaccattttattctgcaaacacagagctatacccaaactgaagacacagcatgacaaattagcaagttattgagaagtagagagtgatgccttttccttttatttgccagtgataaaagcaaagtgataaatggagtaaagtgttaagtgctgattagagaggacttgaaaaggactggcaaagaagcctgggcagagtgcaagaggagagcccagggaagaaaggccagaccgtgccatcctgctctgactcactgcccagattaccaggacagtgcccttcaacagtcctacagcagaacccctctgcttaccgggagagcaaacacaagtatgtttgttgagaggatagaaagggcatcattttttcttcttcttcctcttcttccataaagggtactgaattttttttgaagcttgagggtagaagagccgaagtacaattacagtagacaggtgggaaaaaaaaagttgcattctttaaaggaacataagcttttcattgtagcttgaaaacacttgaaagaccaaggacccccaagggtgcccaggcaaggtcactcttgactctacgcagagaagggctgttgctgggagcaaaggatacctttgcccagttctcaccaggggacttgtagtctcgcaagggagggatgttttctgatttgtctacccaaaggccgccctttttctaaactcatgggggagtggctgctgaagggggcagttacagcacctcacgaggtgctgccagcctgctcattggcagaggcttaccttatgaaacactgggcctcagacagtgatgctcaggccccgccttaggataacaatataagtatagttcagattgatggggcagaatttaaataattaaatgtcgttattttaaatttcttttaaacatgatcatttcacatttagttgacattgcgccatttgcccgcagactgtgcattttgcagtgtccatttggccttctaaaatccctgtgaattatatttaaaaatcggaacgtaggactcattcatcatatttaatagggttagggtttatgatgttgcaggttaataaatagccataatagccgctcggcgttttctggagtcagaacaccagaaatagtcccttggctctctttcctttccttgtgaatctttcaaaattcttacattactactcctgcttgtgtgtgtttaataatttaatttaatgccttcctttggaaacattacctcgctgctcacccactcggctgttttgccttctcagcagagtaactgagtttaagacagccacgtgacaggcacagctatattagaaccagcatagtgagaagggatgcagtgcctctcttttctaattgggtagagcaacaattttatatgctttcacattatgtttgttcccaaaaaaaaagaggcaaaattgggagctgaacgtgatcatcattattattttatatttttatacataacaagatgcgctcatacttattgtctcacttaattgtacagcagtccttgaagcaggtgctattgattctgtttgatgagctgaccgtgtctccgataggtcaactggattgtccaggttcacacagcatgtgaaaggccgaatgtgatttctacttcttgaaaccacctttcagcttttttaggagaaaacataatgacataaagagtttcatggacttgaaagtagaggcactgctgaccgctgaagtctgggcagccacaggtgcagggactgggaccggtgtggttctagtgatgccacctgatcatgaagttgtgctgaatcctcagcagactggcttctccctcgtagtaggatgagggagaggaatcaggataacagcctgtccctgtggatggtttattctggttttgttcaccagtcctgctgcctccccgtttgttctcttgcgagctcaggttagagttgaatttctccctacaaccagaatgccagggctggtcctgtaggccctgatgggccagctctgagagtgggctcaatccagtacccaattccccagcattttgctaggggtgcccttctaggagcagggtctcactgcttttggaagtctccaaataaaaaaccatggtaatagaaagggcttgggtctggatagacgtgaatggacttgaatttcagggttggctctattagagagatgatttaacctctctaagactcaagtttctaacgacacctactaatgagggcttcttagaagtatcagagctcatttatgtatagcacctggcatagtgcctggcctgcagtggccaggtagctcaccaaagctccatttctgtttccggttatggtgaatagcctgttgaggaggtggcttccccatgcaggagccaagggaagcagacatgtcgttgtctgtgtgtttcattaaagaaaggacctagggttctgtctgtgtattattgagactaatcttcctaagtcacaatggaaataagctttgctttcaaacgatcccctgtgatttccaggggctcagttttgctctagggcactccatcccaggaccttttcctacccacatgtctctccctcagtctggaactttcttcccgttctcgcctgaatctgtgaatctccttcagccttccccactcttctaatacctatcaagtcctcccctgtcctttgctatcacatcagtgttccaaaaatggcctctcctcacagctgcctgtgacgtgcagtgatatcaccagcagagttgagacaaggacaaggagaagagatttaattctctgtcagtgtcttacaaagcagtaatgacttctaacaaagccgaccagccactagcattttctactttgttcccccttaagccttcttttgggtgccttcactttttacatccaaatgcttgaagctttctactttccccgcggcacatgtggctgtacgagggccctggttagctgcttcaaacagcttgaagagcaaaaacagcccacagcagaacagccaggatgctttggaagggaaatttcctttttgggtttgctgtctgaaagaatttccgatgcaggcagacgttaattcctagctccatgcttcctgataaggaagcagcttcaataaatgcagctatttatagatgtctttttttttttaagaaaaaaaatatataaccagaggtttactgaccttttctttcacttcacatttcatgcagtgagctctgtgtacatttaaggcagttcctccagcgtcagctctgacaaagtggccctggtttcgctgtgggggatggggaggggaggatgaagatggcacggcccctcattagtgtcacgggctctccctttcctcagagttctgaagtagacatttggaaactgttgacaatgggttgtccctacctggtgctctgtgttatttatgtgagcccagaggtgcccagctttattctagactcaacactgaaaggttatagcagactaagagaaccctttaaaaaataaaagacgatgagaaccagtccattttatgaaacttgaacagcaacaggaaatcagaaactttatttccatttcttcttttcttctgtccgttgcttcctcttggattttcccaaccctcaatacgtctgtggtctttctctcgtcttgatgggtttccgcagattgaggagttcctgtccatgagctccacagtcacccttacatgtatctacctaatgctttctggcaggtgtgataaaggttcagtgtgttggcttgaatgtgcttctctaagttacttctcacctcctctgattatcagaaagcattggttgagctgagtatatacaaatacagcagtttccatgctcaaataactgatattttctcccattttgcttcatgtgtgagttacaccacattagtaattcaaacttttggggtttctggcaggatgaccttgacaacttcatcagaggtaaacgttagcagcgacgtttagatgttgctgcttttgctgttgccatgggtggattctgattctcagttgcctgtaccatgtgtgagtgttttgtggttcatttttctgatctcttctgaaggaggggtagagcaggacttgagagatttaaactggccctggctctggccacatgctgactgtaaattcccaagtataattagtcacactgccccaatatttactgcctccatcttgggtgtgtggacaaaaccccattctttcaacattggtctccatttctgcttccagcagatcatggataccagtagctctcaaatggggctgtaagattccagtaatagaaatgcagatgatgggtacggataatggataaagaactgtagatgtggggtggatgacgattggatacctagaagggaaagttgactgcacagggctacgcagtgaataccctattttaccaggtcagctgaggctaaattctctacttctggggtgggggtactaactgaaatggttcactgaggagggtgaaggtttgtaagggaagatgtaacaatacttttttaaaagcacctaggacaagttttagggtgttgaatagcaccatttaaaaattataggggtatccagcaatttatggagctctgattgagaagtatcattgttaggattttattacccatttgttttccagaagtagctcatctttgcaaatgagctttagttttttggtcattgtaccctacctgccagctcacaggagcctgtgtttctccttaggagccactctgaggtcaaccgtgtttaagatcataaagccactctagagaatctctgtggcattgttgtgtggaagaagaaataatgatcactactattattatatatatgtgtgtgtgtgtgtgtgtgtgtgtgtgtgtatataaaagtatatgtgtgtgtgtgtatatatgtatatatgtgtgtatatgtatatgcttcatatatattatcctgaataataacaaactctgcacagtagatattatacctgaggctcaggtaaaccacttgcccgaggtcacccagagaaagtggaggagccccaatttgaatccgtatctaattccaaaacccagacttttattttccacttcaccctattactctttaaaagtctgaggagcaaatgaaagttgtttcattctatctattggttagaaggagaatatccaagctaacaggctgatttttttttccaatttttaagcataatataaattactgacaagagggcccagatggataaaatcagagctataaaccaaattatcttttgaacttgaaggaagataaatttccatatccaatcctgtatgcacactgttatctgccagatagtctcaggtatgtgtgtaaattctggagtgttagaaacaaaactaaatgaagtaaaaagaggttccttgtctattattttccatcttttttaaagagatgatctacctcacagatggttattaaacagtaagaaagatgctgtgattgaatgaagattgtgttactgagtttacaccttaaaacactgaacttcctgataatttgtgttaagccaacacgcttcagaaaaattgcctgacgtttggtgccttagtttacccacatggcatgtgtgccagaacacgctacaacagggtaagagggcagagaacatgctcttgtaggggtcagttccttgagctctggttctacgtggctgattacttgggtcatcccagcagttcattccatctctcaggactgtggtttccacatctgcaaagtgaaatggcctgagtatatgattcctaagttctccccaactcaatcgtcgcattgttctcttattccagaagagaaacacaaggggtatcagcagtggaacattatctgtaaatgccagatttcatgatcattcacttgatttttaggactcaacatcaaattttagtgcagatggtggtactttcatgacacaggaaattgtccttcgttttacctgtgattgttttgggaggaagccctcctgcaaggaaatagggaaatccaacacccagctctgttgagcatttccctatggttcctgtgattgaaatcgggttaatgcttttgtgggatgagaactggtgccagctcctaggccttgcagggcttctaaagactgtccctgccactcttgccttatgctggttcccaggaccttacagccagatcacaggcctgctcccctgttctcatagccccctttctggcctgagaattgtctgtggcttggccctttgccccatgcaacatgcacaggtgtggcttctgctaactatctacttgaccccaactgtgtgattagcggcaatcccctctgcaactcaaggcgtgtttgcctttcctgtaacctgtaaaaaatttcagtctgcgtttttctccctctggagatggtatccactgggttttaggctttacagagccagctgatctgcgtggatgggccacactatcctcccttagccggctccgtagcacatgcacaattaatactgcattaattaattatgggagaaaaaaagcacagttggcaagggaatgaaggctttcagcttctaaagtgaaggctttgatgctgagcttgaaagtacatttccatccgcctcagccagcagagagaatctgtgacacttataccatcccctgggcatgaaaactcacacccaaggaaagtatttctaaatagaggccctcaactagttgctggaatcatctactcattgccatgggctgtgaaaagggggtgtaagattagggagaaaagactcgcccaaagcagcagtgattcgtgaccaaagctgatgaggggttttattttttctccttaagtagctcttaagtcaccaacatcaggaactctttgtagagaaacaaatatgagtaagtgatttggtgccagccctcttgaggacataaaatgactctttctccttcctcctcctcctcgcatgccttgcttcaggaaggaaccctaaggtggtgcaggttcccaaacctgttattcggatgggttggaaggttcatctctgttaggcatggtttcccactagatatgaacaaagtcggggagaaaatgctttcctttttcattctgattccttcacgccattgttcttgaactcctcagctcccacactgactcctttcacttctcctatgaggtggtagtgaagccacctcacaaagtcccctctctgaacagacgcagttctcgttcccctatttacaactctgtcaagcatttttcgtgggggctcttgctgaccttaaaatttggccgtgattcaaatattcatccaggtatctggggttttattaaaggtcttttaggaacacaaaagtaggaattccctgagagaggttttcttcacttgagactcatgggttataaatgaaactactggaatgccctgaccaagtgctgagaggagcttcagagacccacaaaaacctaaaaagatgtgaaatttgtctctgatcaaatagattttggaccttatgaaagaaaataagcttttcttttgattcttagagaaaaatttttgcttcagatgaatccaagtgtgtgtgcacgcacgtgctttcgttgggatcgtcttatagctgttattccagatacctgcttcacaaagcttctgtgattattcctactactgtgacgattcctgccaccccagtgatcggggaaaagaacttgaaatacaactgggtattgtagcattggcactgtgcagacgctgtgtagctctctcatgtctggtacttctttgtttgctaaaggagtattgagattcagaaagtggctgccttctaaacctttattgttcagatagcattactttggacccaggacagagggcttatagttgactgtgaacggggtgaatgttatacttaagcagggaatgtggtcacccagttgcaatgatttagagtgctttgaacataaatatctcccacgatgaatgaccagggtgcctgaaattccattgttgagacattccttttggatcaggcattatttccacatagctccacttttaaaagtaaatcattatggcaggagatagttatggagagagataattaatacctcaagtccctaatatcttaatgaaaattagcttatcagatctcctgaattttttgaagtggaaggaccgtggccagcacggagtgggtagagttggaaataagcactataatttgcttagggctggccttctctgtggataagacagatggaaaactagatggaaaatccaggcctcctgatttagacaaaacattgtgagcctggagctctgaggccaggatgagcagtctgctacttactgtgcgtggccattgctctcaagacattgccatcatcagtcttggccaaagaaggtcaggtctcctctagtacactggcgatttgagaatgtgcaagtcatctgcatttctttgacaggagtagtgaatttgggagtataaatctgaatccttaagcctttcaaccattctcactaaatgtctttacttcagggatgatcacgtttgatcgtaatgccaagatcttgcagatgtataaagggcatggtaatccaagtcttgagttgaagtaagtggtcaggaaaatcttgacccttggggaaggagctaccagagctgggtggcctatgtgtgtgtgacagggaggaggtgtgcagaatttgggggaaagatcctttgtagttctccatgtggaataataacttccatttattgagtgcttatggtaggcgcttttcacatgtattgtatcatttaaccctctaggcagtcctgtgaactgggttttattatcctcatcttactgatgaagagtcaaacttaaagaggaaaaggaacttgaccagagtcacagaggtggtaggtgggagacaggtccatccaatatacaccttgccttccaatagaagccaaagccctattgcctaatctcttcactttaagaacatgaagaatagtgttgagttcccctttgagatctgactgtggttaaagcttcacaaatttcagaaaaacagaataactcactaaaataaaaatttaaagctaccccacagaaaacatctaccacaacccaaaacttcagggtttatatatccagattttagtgaactatatgactctccctagtcccttgctctgtctcctggtaaatactgtccctttcagagccctggcacatacatagtgtaataagatcagaccccatccccctaccattccaatgcaatctaattgcaaagtgaaaatccagggccgtcttagatcctcatctgtctacgtctctcttggtccccactgcttgatacgcagtctcaggttcaataccattctctctttttgtgctttaggtctctgtattgtttccttttcaccacttttttttttttaatgaagtgattttaaatggaaaattaaaaacttaactgtgaatctggcagtttcctgctaatgcctctttgctaagaagcttcataaaatactgtatcttattcacttcagcacagctgctgtgggctctcaccacttaaccattcacaatatgtctgagagattaatttttgtaaggctgtggtttgagatatctcccccttccttgttttacttaaaatcctcagtgggaaagcgtgcatggggaaaaaaaaaaccaccaccaccctggataaaaggtactttggtaacatacgtgctttaggaactataatttgtcattttattttcttgtgccctcttcatttgaaatgctgcagcctttctgccagaagtctcaagtttgtgtatgagactgagggggaaacgagagtaggtaccttgtgctgagactgtcctgggacagtcccgtggtgggtgtgagcgtctgtgtgatgcaggtatgcttatttcttcatgaaagccgcaggtactggttgcctctcgcagggttaaaactcttggcggctcacaggaggtgatgaagagcaagggcacgggagaatgaagaagcaggaggaaggtgtgggccagggtcggtttcggtggggtccccacttgctgggtgaaagctgaactgtttatccacacatcccagcagcagcagaaagccaaggggtgttttcaggactcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccgccattagctgccaccagctccatcttgaacagctctcgagagcagccggcagccaggccgggagcctgtttcttgctcccttgctttgtggctttgcccatccctgacctgcgtggaggccttataggttatgtgacagccctatgctgccaagacacagaaatgacctctttccttccccttttgacataaagcaatgattgaagacgtcttcagcaatggggtgggggcgggcagtcaggggagaatgcagccatttcctcaggccggcctttaaaatcttgaaggcagtaaatgtaagtgctattccggtcttgggagctgggtctgaattctttgctttgttgaaggaaatagggctctgtgctgggtggacgatattcttgtacctgaacatgtcattttcttcagttccatcagcctgcatgtggtgctttgttttgtttctgaaattgacatgatgatgccttaggaactaaatttttttctttaatggaacaggctaggagaaagaaggatggcggtatcatttggggcgtgagaacagtcattattaattaggcttaagttaatgaaataaaaaaggcacaggctttgaaatcagttgtctaaatttaagggccagctctaacaatatacaaccagcaatgtaaccttgaacaagtcactgaacctcccagcctcagtttccttatctctaaaatgggtacagtcatacctttttcacattgttgtgaggaaattagattatgatttcagaggcactttgtgaattcctataagccttcatacttcttattaaaccactattgggatctctggagactgaaatatagtattaggctaagacagcagaattgtagaatttgtagatcaatttggcaaatatttagtagaagtcttctatgtgtgcagcatggctcgactctgtgggggaaaataaacaagtggaaagtttcaggtggccgcatggtatagcagaaagaatattggacttggggccaggaggccagggttcaatcctggctgtcactcagttgcctgtgacttggtatgaactgtttaaccttgatgagcctcagttgctcatctgtaaaactgggagaaatcaaactctatgaccttaataaactctgtccaactctaacattgtataatcagttttaagaggtttttgcctttagcagctgtttataggatttattctaaagagtagggaagaaatattcattgtataagagcttgtctgatgaagaagattgcatgaaaaagctacacttttttaataagtatatctgatgtaaacaggaaaaatgggtgcttgccagatatgtcatctatagcaacttgttttgagggggtctctgaatgctgacatgaaaatgactaggatcatgggttgaacgtgagtttgctcaagagaaggttctcttggggctttggtttacttcctcccagctgctccagggaacactcaggatatttccaaatggctgctcatttaagccattcccgttatggttctccttgtccaaattggcttccatggtacagtcccagtgttgactggttctgctaatttgattctttttttttttaatgtgctgatatgtagttttaggactgctgcattattgttcctctatctttccgtttgtattagtaaagaactattagcaattttgcctcagtcttctaagcacgctttttgattggagaaaaccaaggtaccagaaaacttagataccatgtggaaagtcacagtttactgggtgtgtactatgtgttactagtgctttaataaatttcctcattaattttattctcccagcaagcctggcaggtagctgatagtatctttgctttacacatacagaaactagggcttagagatggtaagtaattgggtcaaggccacagaactggctggtagcagagccagaatttgaactcatgtctgcctgctccaaagcctgtgttctttatcccctcagtgcacccctactgttttgactgctgttaaattgaccttatgcttagaaccgaagtcaaacccgtaccagggctgcaaaaagaaacaaaattaacctcatagtctgcatactctcgaaatggcaaaaaagcctgcaactttccgttgtggaaaataatatacctgggtgataaactgagcaaacatcacccttgcccttgcctctgaaagagagcctgttctagttcatcctggggccagcttggcctggaaccccactggccagctctgtccacaccttgcatattaggacagaaatctgcctaccacattccagctacataaagaaggtggccagcacctgactgcctctttctccttgtgaaattccttggaaataccatttgtgactgcttgggcttgttctgaagaaaattcaaatcttgttctgtttaacaaggattgattgaagaacccgtaggctcagtgctagtacaaagataagcaaggaaggaactcagaataagagagaaaaaacttggataataattatcaaaaccagtatttattgagcacctactgtgcccagtagagtagtaattacaggaggtaaatatctaaaacttacatagctcttcacagaacatacatctgttcttgcttctgtgtttgattttattagctttcctctgtacacataagcttttagtgtatgtcctattattgaagtccagagttttattatttttcacttatttgggcatagatagttccagaatttacttgtcttcctcattctcattgttaatctcatttttcttccctggagaatatggactttcaaaactatttttcaatcaaggccaaaatatttcttaaaattcacttctatttaaaacacagataacatccaggagaaaatctgagaagaaaaaaaaaaacgattttgatggtacctgattataaaagactcacagtactaagttattctttggcacgtgtagcaaaatactatgtaggtgtcatttcgagttcatagtaaggggagaaatggtgtcatttttcctgcagagaaatttaatctttcactttaatctttcattggcctatagcagccagtggggtcttttaaaaaattcttttccttcatattccccgtttgagcttaaggtacaaaaaaagaaaatactcttgaaatgctgtgaccagatctagactgtaacatgccccttcactcctctggtgaggaagtgcgggaaggtggaagacattgaggggttgattatttacttcgtttggaagtaagaagggaggtagctcttatttggaataagagctgtcttcagaacaggtgtgtgctctcctgaagcccagagctgtgactccctgggtgtgtctcttacctgtgcccttgggcaggtggcacgggagaagaatacgataagaggaggatggtacagacagaggagtcacaggctgaacaggctgtcaccggggcaagatgactgacaggtggatggaattcaccatcctttcctttcaatcaaaaaaaaggtagaaagttgctcataagtaagtttgagttatatcatcttcttcatagccgttgctcttcagacacaggtgctggtaatcaggaaaatgcaaggaaacagctctggggaaaaggaacaagcctcgttggccttgagagccccagtagaccatcaggccttgctttggatattgggaggtgacagtgccttctcacgtgcctgacagtttccctgcaccaccaagactctgtgtgactgaggccgtggcccgggtttcaggatgggcattcagaggaaggaagttccccctccttcacttacctcacgcttactagatgctgggttgcctatgcccatgttaaaggaagccagataactttctgtccccatgtgatccaggcccatcctgaagcctgggggttctgaacataagtatggcggttgcagccttccttctgtgacttctggaattcctgacagagagggtcatatctagccactgtcaaccggatgctagacttgttttgttaggcccttcctccttcccttcctctacttatcttccaataaccttaggatttggaggaaattaaaataaaccttcttctagaaaggtgtcagggacccatgcacaaatgtagcctttttgatgcttgagaaagaatgcctttttgacttccgtgaataaagaataagtcacggctaatgagtaagtaacagcacgtgcctgtggtcccagttattcaggagactgaggcaggaggattgcttgatcccatgagttcaaggctgcagtgagccatgattgtgccactgcactccagcctgaacaacagagcaagaccccatctcttaaaaaaaaaaaggaaaaatgcctatgcaatggctctgaggcaccctcatggttgatccaatggccttgcctagtgattttgacatgctttaacttgtgaccaacatctagtctatttgtctcccattagagactggttgtgacagcattgccattgacctgccatatataggaactccagtgtctgaaaacatagcaggactttgtaggtattaacattgagcagtgctttcacattttacagcttaccgtgatgagcaagatattgtgtcaaaaatagtgcattgcagatatcaataagaggtagggtaggcagtgatttcagtggtgtcccactccacactgtaattttgtttctttggtcaactaatgtaagaactgagtctgtaactctaacctagggagccattgctgtgtgtcaactttgttgctttaaaatcttgagacaccttttcagtatctcccactttgtctgagtagtcatacttttaatgatatttaaaagtcaaactctaaatactttggagctaaatctcagcagagataaacttcaaactggtgggagtgggggtagagaaacccttctgggagtcagaatgagatacttgtgtgtctggactggtggcaggtttgtatgttaccagagtgatctccatggtaacggatcaacatggcgccaatgacaactctacactaagagcttcaggttcccatgagaaagtggatcctcacagcaaataggaagaaatcaagaaatatggatccacactccccttccctgtagaattctggccgtgaagtttcagttcatataaccaacaccatgtcctatttaaccacttgggtccctctgagtaaaccaagactcttctgagaatgcagtgttctctcagatttcaactaaattcatacaaagtttaatcagacttgcatagcaaagaactatattgcagtggagcaagaatgtaacttggagtcaggaagcctggcctccagacccagctctgacactgtgatatgaggaaatcacctcgcaggttcttattttccagattctcaaattcccaccagtgctgatggtcaatcatccaattatattgaaagcccttagtatgatacatcagcagtaggaaaggtagatgactaaatataatacagtgtgccttttcctacaccatcaaaggtatgataatgttgtgatcatgtgtataaaaactttcagacacctaaaaagtagaaggtgtgattcatctctgttaaagcttaatctctgagcataacaaccaacatctggaagctaggcagccaacagaggggttaatttttctggaaccttggttgcaaaaggttattagtttgcagaaagactcagagatcactgtttatcttaaaccacaagagaatgtttttgaattcagaagaacagtgatatagttcggtaatttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaagaatggtaatgctccatttaaactttccttgtgattctctctggtctaccttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgccgtgagccgagattgcaccactacattccagcttagtgacagagtgagactccatctcaaaaaaaaaaaaaaaaaaaatgaaatcttgatcttattgccttgtcacctttttgtcttaagtttactttgttggtataaagaattttttttaattcagcaagagctcaaagagccatatatatatatataaatttttttttaattaaaaatctttctgctcaagtctcaactacagtgagactgaatggaaaatgcaaaagctcttgacatgatgtcggaatgaacaagatggagaggttgaatttgagaacatggtttccttattgtgaaattccagtttcagaacattggcactgtctggttcaaatataaatacacattattttattgtaatccgctagtttaaattgtttattctgcttataaggaagagatccatgatagctgtgaacccctttgaaggagactttatccatggctcagtccaaggtgtttgaagcacttttctcatggcctggctggaaagactttcagaaataagcagggttctggtaggaaaatgaaggcagttgaggaaaacagtgcacatatttgtaagaggactatacttggtatcttggaaaacataaacagaccctagactgtctaccccaagtctgggaaggcggtcctctgaagctgaggttctcctggaactcccttccacagggctgcgttgcaaatgccattgtggaggcatcacccgatgtggtggacctgaacattggggaaatgcagtgctgcctgctgctgcgctggctggcatctgccctcctccgtctcctgggtgctgccacagagaagagagagagagtgaagcgggcagagactggctgttgccatcacacaactgagggcggacctggagctcagccggctgagggtttgagagaccgttgggagcaagacccaaccacaaggcccatggaagaggaagttggcagatctcagaaaggggaggaaaaggagaggtgcttatttgttcatcttgtttttgcttttaaggaaaggaggagagttaaatgagaaaggagggcgagttgagaaggttctgagcagtttcaggtccacggttgagcaatgttcttcctggtcaacaaactgcctggatttcattttggcctgacaacagccccaccacctagggaactgcacagagatcctgtgtgttaaccacgcaagagagtctgcagttagaatactggggcttgtgcagagagaagaattcagaaagtcaaaggctggatgtaggtgaagagactatggactctgccttcatgtcatcagttaaagtgccctgcacacctgcctgtcctaggtcctgtagggatgtgatataacaagcatgagctataccttagtgtctgtgttccagaactttgttggctcccgaagcacctttccctcctcccaagaggaataaacaaatgtaaataaatggtgcccaggttttcatttggctcacaaaagattatataaaactcatagtctgtctgaagtatgttacctgtaaacctgtttcagctaaccaccttttctagcacaatcaagctggtaaaatacatgcctgcacgccagccacggtactgaggaccacatcaaaactgctccttgaaggaacttggagaaaatgaacaaccagcaacttgttagctggtctctgaatgacagagggtactgctttagatgtcccccaggaattctgagtttatgcagcagagggaccgtagccccggggtcaggcaggacaaggggatcagaccttcctcttgctatgtgtggatcattattcagctgaatgtctctaatcaggaactctgggcataaaaacacgatctctgcagacttgtgtgtggctagacgccctctgtgtgctgtatttgtaattctctgtctctgtatggtttcagccttggaagaagctttgaaccagtgatgagtttgctttccgcagtcaaaactgtggtttgagaatttcactgttaataattgggagtaaaggaaaaagctgggctattgaagggtaaagccgatgtccctaggactgtggcctcaggaagatgactggatggcggcagcagaactgatggcagaaaccagggaagctgatgttgtattgcagcctccctcacacagattctaatcctagaaagtggactgtggaaaaaaacttaactattcacaacaaacgtttaccagtcttatttagtggcaggccttgtgatgagtgctggggttaaaccataagtcaaatacagacactgctgtctttattattcattaaaatgtctttagggtaattttgtatttacatcttcagcaaatattaactgagcacctgtgatcaaccacatagctgctaggcactgtgaataccgtggtagacaagaacagacgcttttcttgttaatccgtggaatttacaatctagaggggagactccacctaccccaccagatgtgtgcagaaggcgccatcactgctttagtttcaggtctttgctcaggtcattgctcacactgagtccacatttataagttttcctgtcgggtgagctgccgaagggccagggaacgtgataaaccatacaagcagcgcatccaagaagtggtttctgagcagtcactgagacagcgagggttccctgcactgagcaccaagttattactattttccatacacgtcaatatgttattgattgcttcactgtgctgatctgtttttgtttcatgtggctctttgggtctgtctaacctggtattttcagtctcaccagcatttctaaagttctagagacccatttcatccaccttacaccatgtctaccacagtgccaggcatcaagcctgctaattgtgcttgatggtgattattaccagccccggatttgtaagagtcaccagcagtggcatttcaagatttagcctgggagctcacggttatgtggaaagaggggctcaagactaagcccagggaggttttggggtgatagaattgattctttacactgaacgtgaatcctcagtgatgttttgatgaggatgcgggacattgtgctatgctaaagcccgtcacagcagcattaaaaatgtcccagtatggagacctgacttacaccttggctcaatcattaaattaaataactcaccaaagaataaataccaacaaatactagaaatgttgatttttagaataataaaatatcagtttttgttttttgaactggcagggaatttttttttttttctttttgtagagacagtatcatgctatgtttcccaggctggtctccaagtcctggcctcaagctatcctcctgctgtggccgcccaaagtgctgggataaaaggcatgagccaccacacccagccagaattttttaaatgttaattttcaatacacatgtagctatgaggagatggacacattctttctatctgacacacctggtcactccaaacgttcagcacttcacatgggaggctacatatggaagtgaaatgaaaaatcaccagcagccgcagaacaaaaatataatccagtgagcataacttttatggaagcacttcagcaatatgggtaaaggacctgaaaacacttttgctctttggctcactaattccttttctaataacccatccctagggaacactctccgatgctgacaaaccttcttacacatggttctgcagagcagcagaggccaccaccagcaaggttcaataaattaaggcaggtcattatgtgggactattatgcactaattaaaaatcacattttttaggccgggcgcagtggctcacgcctgtaatcccagcactttgggaggccaaggcgggtggatcacaaggtcaggagactgcgaccatcctggctaacacagtgaaaccccgtctctgctaaaaatatttaaaaaattagccaggcgtggtggcaggtgcctgtagtcccagctactcgggaggctgaggcaggagaatggcgtgaacctgggaggcggagcttgcagtgagccgagatagcgccactgcactccagcctgggtgacagagtgagactccgtgtcaaaaaaaaaaaaaaaaaaaaaaatcacgttttttaaatgctcatataatataattgaaaaggcagggtacaaatctctctcttcagagtcatctcaattgtttttaatccataaaaataaaccaaaaggctatggaggaaaatagttattgtggttatctctaggtagaaggattgtgggtagaatttctttctctttactgtggagtttttttgttttttttttcttctggcattgcccaggattatttctgtccatcagggcgtagtgggtcacttctgtacccagcagcttgcacctagatttattgtgtcaaaatgcaaatctgggcgtgcattttccattgtcccctccccacctgcgcttaaaacccctccttgtcttcctgctgtaagtaggataaatgcaccagctgtactgggcctttcccatttcccatgctgatcacattctctcgcctctttcttctggctacaacacacttcttcattccaaacccttccccctgacccacctccaccccccaccctagcaagattaattccctgtaattctagttcatccttttggccccagtttaagccatttattcatgccaggctttacagaagactcaccagcacctccaatgggcttccaaggtgctctcaacttcccttaacacaggttcccagtttatcctcaccactgaagcccaagagctgggactgtgccagattgatcaccagtgcattcccccagcacacagcaggactcggctcaccctggatggttcttaagcatttatgaatgggtggatctcacctacgtgacctggaacttctctgttctcagagcaagccatgtcaaatagcagaaaatgcaccggctttggagcctactgcaggactagatgtctcagggtcgcagtttcctcatccctaaaaaggggaatcacgatgcttatctcatgcagttattgtgaggttacaagagttactgcttatgaagggccctgtccagcatctggcacgtggcaggtcctccgtgaatgacagcgccttcctgggcagcctggcgagcgcacacgcgtgtgcacacacacacactcctgtgtttaatatagccctgtctgttgtgagccacttgaggagaggtgtccctagaagaaacttttttcccagaaaatgaggcctggctggtgctcatcctgagttcctggaaggcagtgttttcttgtaaccatctgagattcctggggctgggtatagtgcctgatgctctcaatatatgcgtgttgaatcaaaccagaagaagcaggctgaggcactgagtgaaaacctatgtggatgtcctgctgccttttccttgtggagggtagatcattcccaactctgcctgaaactttgatgccttattggaggaagagaaaggtaactcccttgttgagccatagagctcttagtttttctttcttaaaaaaaaaatcactcttctttcaaacaccattaaattagtccagttatgtacactgggcttgtattgcatggtttatataaaagctaagttctttctttaagattggagccctccgtgtgagtgatttcaggataaaaggccttagaggattagacacattattcgtttgtaaaactgattgctcaagtgatacagccctagggctgcccccttattgtagcttcttgaacactgtcaaactgtcagacttgggttggtggttattttatctcgcaaacaaccaaaaccagatttacattgtaagtagatactagcgtggcttttgtccttcctatatctaggccctgaatacttcagagccagattaaatgctttgctctattttttcatagatttgggcttcgaccaaacatacaagttgagcctgttgacttctctctttgtggatgcacacgtgcgtctctgcgtatatttgtgcatgctttcccgaataagtcctcttttaaaactcagcctttcatcattttagaaatgatttgctcttttacagcttgtactttttatggttcttagaggatcactgcagcaaatatatttggcagaaattgagcacacaagcccttccccagaactcagtactgaatttgttcagttcccatcttaaaaacttgaaactcctttgacttttcctgtgatgtgcttatttctgatctgaaactgtagttcaaagctagacttggtaatcattcacgtcaagaaaggaatggattgctcaaaaaagaagtcagactctaaaaatagcctccataccgaggcccacttttctacctagggaatcaagacagaaatatttccaggattgaaatgacatagttcaagtgacgcaaccatttggctgcctgctatttttctcttttctgccagaaggaaaatatataatgtagaaaaattcccctagagttgttaaaataatcactgaaataacctttggtgcttagtatggtaccctggaaaacttggatctctagaatggttcatttcagagcttttccagatagccaagtttttattagaaaattggttggtatagacggtgctcactgtgactgttcagtgcatgatgagaatccttctttacagagataaaaagtgtgaagagaattgctgagaagtaaccattcattcccttctgcatttgcctagtgtgctgtgtaattaaatgagctgataaaatttacaagaaataaagctttatgcaattacaaatagatgacatgactttttaaaaggttttgcccatatttttcacacacgctctacctttagccttctctgctttcacacagatgctgaaaaacaaaagagttaattagaaaccattccttttctctctttctggtacagagaaggcttccactaagtatgtgctgaataaatgacccagtctgaaagttttaatttattacacagtatattcatagaactgtaactgttacaacctctagtttgatagatgtagctgtttttgtttttttaagttgagattatattaatatctgtcacttgggttgccagccttttagaagaaaatttggggtttatattagaataggttttaggttcagtagcctgtatccttttttactgccctgggacaacagcaaatattcacctaaattcattctgtggtgtaacactttagaagtataccagttcttccttgcaaataacaacaaaaagctctgaacaacttaatcacagagaaaaaaaaagcttttattggaggtatattgggcagctcattggctgataaggtagcagaagcaaaaggatacttggcagcccggagcttagctgagatggagccataaggacagttttattaggatgccaccacagctcggctgccagtggacacatgaattcgtgagactagcacctctgccataaataacatctcaccatccctggggaattggtcactcccttaagactcaaacactgtggcaagtgcatctaattggctgagtccaggttatgttccagggaacaggggagaaagctctgccaatcttgggattcccccacatgcggtatgtggatgctgagcagacaaaaatatagaagtctagtagatgattgtaagttactgtatagcagtgtgtttcatcttgttcttacgtcctgtggaagctttcttcatggcgaagttaagcagttccacatctgcattcccccagatcagcacaccaaaggtgaacagcttgggtttccccctactttcagttacaggtacaagatgttagcaaactatgcaaatctcaatgagttttgtttcctaattctgtttgcatgctaggaaacttgcctcatgatacaacagtaaacccctgctttaagaaaaacatgaggctggtttaatatgtacaatgtccaactcttaggaagtgtttatttttcaattgcctttaataatttctcataaagatcgatgagtctaagaattgtgaaggacctcagagatgatatatttcaacttgtcatccacgtcacgactgtctctttagcatcccagagatagcaggacagtcctcccctgcttgtgtgtattcagtgggaagtacttccctgcccccttttcgtcccgttcttggatggtgctagatgtgaaaaatagagttgaaactcacctcactgtcactttgctcttggttctagttttgccatgtgaaaccagatagggtgtattctttctacattaagtctagagacagaactttggaatcagatatggatttgatgctcagctttgccatttacccaaaatgaaacagttactttaacagtatttttcgtctaatatgtgcaaactaattgctgaatggataggcagttattttattaatgcaacaaaaggttatgttagcattttaatatttgtgttgtattcacattgatcgtttttacttggactatagccaaagtcagaactcttcttttgtggattttttaaacttaaaatatatgcctttacatttaaccctattacgttttatttaagttggctgaggtaatgcctatcatcccttctataaactcctctttcctactttatggcttctatattagatgagtactttctctgtacctttatgttaattatttggaagggaaaaagattgaatgggacgggacctgtgaaagatccctgtggcataccgctagagactgccttccaggtaggcatagttttaaaactataaagttaactttatagttaacaagtatattgtgattatgttttctggcaaataaatctctttgctgccatatgccataaatgacacattatcatttttgcaaatatgcacaatggtactacatatcaattgactgtcagcctaacccataagaaaaagtcaggatagactgtcaagttatttgctgaaatcagatgcactgcttggctctctgtaaaatctttaccaagtaccctctttcactttactcgtctactcatggcaaatctaaaaccttctacttcagcttaggcaagacatcttcttgggtcagtggtagatgtgaacaatcttcgtgggtcagtggtagtttaacagtttgttaaactgttgttaatcaatgtatctactctcggtgattttaagagagaaaagaagactttttgtttttgtctgagaggagtttttaacctggaaagacagctgaaacgttatctgaaatgtgaaatgttaaacattttattattaagagacagtgtgttttttattttactcacacagtatgtgtgcatttgtgttttctgcgactgcacatttgtaataataggctcatattttgtttttcattttaaaattggctttgtaggatgttcactaatgtggaaagacagagggattggggaatcactgggaaatgcttggagtcagtctgttatgtagatgtgcaaggtattgactacagagtgagacactcttgcttggttatgtcctatttctctctgaattttttaattctcaaaaagtaatttagaactataacaccttggtttgtatgagtgtaaaatgatttataagataacctcaggtgtgttgacagaagaaatgcaattaaattgtttccatgtttaagaaaaatatgggaggtatatgtattataagtatacatctattgactggctaaagaagaaaagatgactagggtatgccatgctaaggagtttagattttgtgctggaagtttaaataggggagagaagggatgtgtgttcagaaggcttttgtaggtagcagctgtagcaatgatctaggtgagaaaaaaataagtacaagccaaagcagtgtcagagagatggagtgaaagagaaacattcaagtgattaagcagattgattgggcaaggtgagtggcagatcagatgaggagcaagggatgggaagcagaaaagacaagtctccgtggagcccattatctagagtggcaagacgagaaggaagagcctataagagggctccccagagagacaggagggaaatcacagagatcaaggaaggagaatttcaggaaggaaagaatgatcctgcccaatcagatgctgcatagaattcaggtaagatgaggactgaaggtgtctttggcttttccaagtagggaagtcatcagtgacccagtaagcacaatttctgtggcggggagaggcaggtggaaacctgattgctgtgggttgaaatgtggaagaaagtgattatagatgactctcttactggattggaatcgagagaaaagataggatctggaaggcaacagcgggtgaagggaggtttttgcttttgttttgtttatttaatggacggtatttagccatgtagaattgttggtaagaatcagagagttgaaaataaaggagaaatatggggtgatttatggaacagagtccttgtagaagtgagaaaaaataagaggcaaagtaaaaatggaggtattatttcattttcaatggaaagatggacacttgttacactgaaatcagaggaaaggtgtgtgtgaacataagacagttgtttgtatgggggcaggcttcataacttgtggaaactcccacttcacagcctttttgtttgtggttggttgtttttttgtttgtttgtttgtttgttttgcctgagaagccaaagatacaggaggtggcagtgaaggaaatgggagagtgcctgattgagccaagctggggtccccccaccgcgtggcatcgcctcccagtgggaggcctggagtttgtattgatactaatttgtctgtctgtgtggtttccccctgtgctgctcaacaccgtagtgtaggaggggtgaaaggagatggtgagacccattctttcaggaaatattaactgagcacctgctatgtgccaagtgtgttctaaactatcaagatacaggccaggcacagtggctcatgcctgtaatcccagcactttgggaggccaaggtgggcggatcacttgagatcaggagttcgagaccagcctggccaacatgttgaaaccccgtcttcactaaaaatacaaaattagctgggcgtggtggcacccgcctgtaatccactactcaggaggctaaggcaggagaatcacttgaacctgggaggctgaggtgggaagattgcttgaaccctggaggcggaggttgcagtgagccgagatcacgccactgcactcgcgcctgggtgacacagcgagactccatctcaaaaaaaaaaaaaaaaagatacagaatttaacacaggaggagcaagccatgtgactatgtgagttcaaagtattccaagcacaaacaacaataaagaccttgaggagggaaagtgtttgatgtattaaaaggaacgcgaggaagcaaatgtgtctaaagtgattggcaagtgaggaagagcggagttcggaaacaggagtggggcaagaggacttgggaggaggctgtaggccactgtaaagatactgtgttttttgtcattttctgagacaggctcttgcctcggctggagtgcagtggtgtaatcatagctcactgcagccgcaaactcttgggctcatgatccttccgccgcagcctccagagtagctggaactacaagtgtgcaccccgtgccttgctaattttttttttttttttttttttttggtagaaatgaggtctcactatgttacccaggctggtctcaaactcccagcctcaagcaatcctcctaccgcagcctcccaaaatgctaggattacaggcatgaaccactgcgcctggccgggactttggcttgtattaataatttgccaatgagaattgtaagcaatggattgacatgctctttgaattttaaggaatcattctagctattgtgtagaggataggaagagggagagtgggagaaaggagggggaagtgtgaaagtagagaggcctgttagggatctcttaataagtctggcaagacatgatggcaggccgtaccaagcatgttcctacctcaggcctttgcacttgctgacctcgctcgctgggatgctcttctaccaaatatatacttgaaccactgcgtccctccttcagagatatctgctgaaatgtgaggtcttcatagtaaacctcaccccttcacttgtataccctttccatgacattttttcctctataacatttatcaccatttgacacagtgtatattttacttgtttatttacttagtgcctgatttcctgactaggatgtaagctcaagaacagggatttttctgtttcgttcattgctgtgtccctgatgcctagaacaatgcctgcagtgaggaggtactcaataagtatttgttgaatcaattagggaatgaagctcttccatctccattatcaccaataccacctctacagttataattagtgagaattatggcagtgctaatgttattttttcatttccatgtgtgcctttttggaaagacttgctgcaacaagcttcacatatcttcctctgcagagtagaagtatgtcactaagccatggagttgatttcttggctccttgtatagcaaatagccttgcatttggttcgtgtcagtctttgcatctttttttagtcacgttgcctacacccttcacaatcctctagcttaaactcttgagtaactctggacactggcgttagctggaaacttgagaaccagaggaatgatactgccaataacatgccttatgtgcttggcatctaattttggcacttgttttagcaggtttgattgcataatttagccattggctacaaaaaaaaatggccacatatcctgggaggaagggaagatttggaggtataagatggaatctgtcctagggatttgaggacgggctacggttcttgttttttttaaaatattccttcattttcaatactcttgggattattccaggccttatgcattgaccatcactcaatattacttcctttggggagtatggtatgacgccatcatttctggtcttttcatatgaagtctccatttttattatatttttcatgcctgaatctcaggttttgcaatattttctctaccacaaaatctgttatcaattaagtacaacttaatttgttttttttttcacttttccctaattaaagatatatatacgctaattcagaataagtatgaaatataataactggaaataggacatataattgacataatcccaaaataaaaacaaataatttgtagatttagtcctcatagtctcactggatcaatataggatttctgatcaaatatgatgcattttgagaaccctcagtttatgtctagaggagagtcttttatttttaatgtgcgggatttaagttgtaagtgaagaggactgcgtcaagaggcaggatagtagttctaccccaaaacagatgtgtgatgttgaacgagtcacttggagaaggatgccatggagagtattgggccaggtgatttctaaagactcttccagcattaaaatacattaattctttgcatacatccatgccttttgctgcttttgcagctttcagggttaatgagagctgtcaggagcagtatgaccttagagggaaatggctcatatcaagagagcagatgccaatcccttctagtactctccctgggcagatgacccactccctatttaaatccttggctttttttcttctctgataagtgcctgcataattgatactgttgccagtgatcaaacgctgaaatgactaaatgatagagctgaaaaagaccctaaggtgttatctagtccaattatgccccctaaaccccaaagagtctgaaagagtaatggggcccatgagccaagtttagtatttcaaatgtctcgtggtaattctatatttggagacaatattgtaaggttaagcaagctgtggaagcatgaggttgctctgcttatggctggagttataaatgtgaaaatggatcagttattcctagtaactgctcttgagtaagcagaatctttcaaaatgtcatagctttgttgtctaatacataatggccactcaccacatacggctttcaagcacttgaatgtgactgatccttactgagttacgctgtgagtgtaaaccacacatcagatttcaaaaacttagtataaaaaagtgaatatttcattaatttatattgattatctgtttaaatgatattttcaatacattgggttatataaaatattttattaaaagtgatgtcgattgtgtgtttttacttctctttactgtggggactaaaatattttaaattccattatatgggtaacatttctattgggagtactgctctagagtaagagatttctgggtgtgaaaaggctgagactcactccttgttttgcaggtgagtaaggtgggtcagagaggttaggccatttgttcaagatcacacagcaagtaggtagccaagttaggagtaggccagcatactttcctttaccaaaaatggccaaagggatcatagtgatttttttacatggagtctatgacattgctgctttgggtcaaagccaaaaatattgtgtagaatattagcagttttctaaagccctaagcccaagttgtatcacccagtatcaaatccaatcaaaaatatattaaaaagaatacaaggaagaaaaggaaagaggagaaacctccctatagaagacccagtaagcaatctgttttcattcttgaacagatttctttcacaccagtgccctggtattactggaaaaaagtacattaattacgggagtaaagcacaataagaaaacatttacaaggagtccagccctcatccatcatgcctttccctccaacaaagcaagaatctctttaacaaatacccattaaaagattaagcctaagaataaattgtttcttagtccccaggcagttcatttgacatcatttccataggattagggactccagcaatatgtgtttagcacagggctatagtcacactgcatagtattggtctaaaccattccaaaatatttttttagatctcgaactaataagacttttatgtggctggtaattatactaatatttcacccacaaattgggcctttttccccctccacagtgtgtaaccaaacgcagcaattctgcctttaaaaaaaacgaaccaccacctgttaaaaagtggtctaggaagtatagcaatgtcatggagctcttgaggatgtgtataattgaatagaaaggaaacctagcatctggcgcactcagttcttagtcccttttcctctgagccatcatttctcttctgataactgtatttggttcttataattactgatactatgatgtgtggagtttaaagtacccaacagttgtataaggcttgttacaaacaccttcaatgtccccactcccctcccttcactcttgatttctttttgatttcctgctcaccagggcaaccacattcaaatcttttaactgattcttttgtcattcacctcctccaattcttaaatcacgtgcttgtattggtttttttttttttttttcatttctaaatattatctagcattatttcactgtaggaaatgacagtttgtcctttcttccccctaccccaacccctcccatagatgcatcctcgtaatcataattttggacagaacaatttagtgtttacatattaagattatataagtgccatttgaagctgagtcacctactcttttatggttcttcttttccagtcacttttctttttccctggagttgataatgatgcttttatagtatatttattgtttttgttgttgttgttgctgttttgagacagaggctcacattgtcgcccggactggagtgcagttgtgtgatctctgctcactgcaacctctgcctctcaggttcaagcgattgtcctgcctcagcctcccgagtagctgggattacaggcgccagccaccatgcccagctaatttcttgtatttttagtagagacgggttttcaccatgttggccaggctagtctcaaactcctgacctcacgattcgcccgcctcagcctcccaaagtgctgggattacaggggtgagccacgatcgtatttcttgttttaatgtccttcttacttggttttttatctccttcactaattcatccgccctgcctcactctcctctcagtagttcagatgccataggtgtgatgagccttgaagcaagagcttctacctgcttcggtctgggcttcagcttggtgcccagctatgacctttgttcactttttctctccttcgggtgtgagtccctttcctgaattctggccttaatggaggacaatttccaatagcttcctgagaaagggtaggggggaggcaactttattgagaccttgcgtgtctgaagaatgtctttcttctttcctcatacttgatagattatttcctcatacttgatagattatttgtcttactgtatgattttagacatggggtaattttcccccagaattttgaaggtagcactccattgcattttttttcagtgccattgttgagaagaccatgccattccgatctttaatcttttgcataaacctttgtttgttgacttattgttccctggaagcatttttttattccccagattctgcagttttacagtaatgtgccttagtctgggtctgtgctaatcctgatgctctttcaatctggatattcatttcctttcattctgggaactgtcctcctgttttcttcattctttctccagaactcccattattaggatgtaggtccaataattatctttatttttcacctcttaatattttaagttcctcttggagagattcctcaaccttttttgtcagcacttcttttttttttgtttctgatatcatacttttaatattcaagtactttttttgttcgacttgttcttcattatagcatcttgtttttgtttcatagttgcaatatcttatttctctctggatgatatttttctttccctgagttgtctgttttccccacgttgcctttgtctggttttggtctttgttttgctgtctgccttctatactcaaacgtctggtgatccctgcatgtctgcccatttctgagagttgatggacccctcaagcactgaaggcaagttctccgtgcctgggtgaacgtgctctctagggtggcctgcccacacatttccttgggatgccattgggtaaatatctccaggtcttttgtctttggctgcttagattcccaagagatggttgactcttctagtagccatcctggagggtagattctagctgccaacctcctaggagcacagtgggagaagaaggggtagggggcacagtgagcacagtggtcaacatatgcatgttcttttaatctttcatataatttccgttaattccacctagtcattttggtaccagaggataaacttttttttttttttttttttgagacagagtatctgttgcccatgctggagggcagtaacataatcttggctcactgcaaccttcacctcctggattcaagcgattctcctgcctcagcctccctagtagctgggatcacaggcgcgcgccaccacacccggctaatttttgtatttttagtagagacgggctttcaccatgttggccagcatgtgggtctggaacccctgacctcaagtgatctgcccaccttggcctcccaaagtgctgggattgcagctgtgagccattgcgcccggccagagcttaagcttctaatctgccatggtaggggaggagccgtgactcgactgtccagattttcacatgtaactagtgacaccagtccccaatcctttcacggattctgccatgtgaatttggttatatcacatctttccttactatgagtttagaattccgctttcttgggtttgctaagtaaattaccaccggttcttctgctttcaagtttctggtttgtttttctttctttttctcccctccctccacccccttatctcttctggtgtctttgtccttgtagatttgtgccttcttaaaaatctcttcactgttactttagaggatttgggggaacgagaacagagctaaaattaacttcctcctctgatgaatgttgacagtcttcctgccatagggatgttgtccaaaatacgtgttcatgtgtatgtcaaactagagcttctcaggaggaaagctctttgtccattgaaattgttgtcactattgatagtctttttacccttagaccagtacaacttgagtcacacgtgtggcccataaagattcctgtaaggtcgtgcataagggacaagtagttgtagctttgtattcgtgtccagttgatgaaaacaaattgctatatctcctttgttacaagaaatctatggaagaatctggatagaacccagatagttatatttttgtttttacactgacccctttaattcaataaagacatcaatatgtgaatacataataactgacacatactactatataagtgttcattgatattgttatatgctgtttttttttaataatacttgtaaattttccaagagttttatctaatgtttctcaaacccagctgcacaacagattcacctggtggtcgtttaaaaaaaaagatttcatttcccaccttgggcctactaatcttcagggtgggtgcagtagcaaaacagagcttccattttctggagaagaagtgagacattttgagaaccccgttgggagggtcgtacacatcactgatggtcatttagaaagacagcaagatgaagcaaggagccagctctgagagctgcggctaaaagcaaagcctgtatccacagcaaatagataaatcaatatacacgtgtagtataaatgtatagaacacctggaaaccaaggcactatgctgggccctccttctgtacagaacacttaggcagtatgttgccccctttctttatgatgttttgcccctttgtttcagtcagattttacctggataggaggatgagcagaagaggctggtgtggatgtgcattttgttcctgctctcccagtgacagacattgaagtgttggccggagctagctaagaatttactttagacaaaatcctgaataggacccacacaactctgagacggattacatttaaaaattaatcctcggccaggcgaggtggctcacgcctgtaatctcagcactttgggaggccgaggtgggtggatcatgaggtcaggagttcgagaccagtctggccaacatggtgaaaccctgtctctactaaaaatacaaaaattagccaggcgtggtggcgcacgcctgtaatcccaggtactcgggaggctgaggtgggagaattgcttgaacccggaaggtggaggttgtagtgagctgagattgtgccactgcacttcagcctgggcaacagaacaagattccatctcaaaaaaaaaaaaaattaatcctctttcagtgtcaggtcccatttgctaatggggttcaattttcattcatctactgtaaaaccaaacaattcttatttgcagctgagctaaggggcagaaaaaggaggaaataaaaagcattaagttttatttccatgtatgcaacccagaaggttctaaatggttactttatttgagcaacttactttattaatagcaacttcttgtttaactagagcagtgttggaaaaataatttaacagaaattttagttagggggctacgggaggggtgggagatgaaaaactgaagaatgacgaaattcacatccactaatgtttacatttttaaagctttaatgtctgtttttaaggaatagttctttaatttaaaaaaaaaaaaaccttaacatattctctgtatactctagtgttggaacaatggtgactgatatcggagctttcagttggtacagtaataatagctaaagctcacccagcactaactgtggcagatattgtcctaagcactttacatctgctagctcattttatcctcccaagagccctttgagaagtttctgttattacctccaatttaagatgaggaaactgaggcaccaacggcaagcttgctcatgagtggtggagctcccctgttcatttaaccatgttgctgtattgcctggtgctgcttaccacaggtgcctggcccataggactttatgtcctggactgggcaaggttatagaagatgttttagttattagacaaagaaagccatgctgttccttccacacaccatctcattcaaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaactgtgtccacctactgtttattttcctccccctttttctttttttcttcatcaaaaagatatgaatgctgagatcatcccagagaaatctagaataaataccatgagaaaatagtccctctggaaggcgtcttgtactcctgctgtttgtaaatgtgaaaagctcagcaaccgggcagctggatgggtataaatatagcccacagcactgacgcccgctgaatcctgctttcttagaggcacaatgggaacccacggaagtcagagaaggagcagtaaagcccagtcgatcaatcagcctctctctttctctctctccatcctggaccttagtgtgggcgtgaggatagaagcagctttaagagtgcacttaaaatagctcttggaactggacattggctaagctcaaagacaaggaagatgcttcctatgaaaccgacctctgcctgacccttacctggggctattttgaccattctggtccgtgatcttagggctgtgttctttctcagttcagctgcttgggcacaagcaggttttctagtgcacgctccaggcgtttggcgcctctctgctgcctccgtactcagagatcttattctaactagactcagctgtctgaagcctggtgattaaaaatagcctcctggtgctagctgtggaatcaagggagagatactcagtgagcagagaggtcagcttgacgcaagacacctgactgtcatacctgtgggtttccttgcacctgagttttttatctcttgaggtattttccttttatactctatcagtgcccattttttatggctatgcaagataaaccagtcatttcagatttgtggggattagtagaagtctgcattttggcaggagaaaaccattattttacttggtggttcccagaaataaagtctctagttatcattccatgcagacatcaatgagatttgccattgaggcatacatttatttgttttctctttctcatttggtggtaaatacttcaaagtaaagaaccatgtcctctacttccgttgtaactgcccacaaaacttaataattcatcttacatgtcttgttttgtgaccgttgaactgaccgtaacagcctttctctgatgtccatggcatgccattagtaagagtcacaaatactgtgatactcgcctaatccatttttaaagtctgttcagggatagtctaagagtacaaggcatatgtgcatatttgcttttagttgtttcattcaatgtaagctggatctgtgccttacttttaacttctaagattgcttccttcaaattggacctcagcatataatatttataaaaataaagcaggaactgttatttggttaaagcagaatatacttaaaatattaaacttgggataacttagagaaagccctgaagttgaagagcttggggctctgtcagtccgctggtggccggagtgccccagcaccgggccttcctcacaaaacattctgcctctgattccctatccttggaactggtgcccagttagcaaagagcaccagctgttctggccttggggacgatgcatggaggaggggcaccctccaaggaaaccaggccaatagagccaaagtgaacaatttcagtcatcattgggaaccatgatagattatgtagcactttaatgattgatttcctaaaaaccattcatgcagtctttggaagttcagcttgtcacttactggcgtgccctccagggcttctgtccacatcgatttcaccactacatctccacccatggaaggcatgggccaaacccattcatattccagagaacaaggtgcagtttccatggtatacagaaaggtaatattgtacagtgggcaataacattccagttccggctctgctacttcctacttctgagcaacttggaaggttgcctaacctctccaaagacctagataaaatggggttaagaatagtgtccacttcatagggtggttcgaagaaataagtgaaaatataaatgtaaaacacttagtacagtgtctgtcacacagcaaggactcagtaaatgttagccaagaggggaggaaggaggctgccacccttatctgttagctcagcttcaaaaagcctagcaaaataacatcatgaatttgatctgagtggtcacagcaaatccattccctcactgatgaagctcaaattaccttggccacattctttagatttttccctttgcctctgaatgaagcattcacttgacgtagataaaatacagacacctcagcctccagttcagccactgtccagtcaagcaggaaagtacattgtgagtgagtcttaagtgaaaaggactagttatgatgcatttgagacaagaaagtagatcgagctttaggcttttccttttcttgccggaaaggaaaaaaacaacattgcattaatcatcatctggtcctcggccaagattcgtatttacctgttatgtgccatattcatactcaccctgtaatgtggcagcctcgtgccatttatcattccaacagcccataacagatgaggagacacagatgacttgtccagggtcatcaagcttgtcaatggcagagtgaatgttggagctcagaccttctgactctcaacccaatgagatacaaataaaatagtggaaaccaccagccagccctcccaagtgtttaggggcattaaagacactggccatcctaaaggcgcctcttactcttatacatcatctaccactgaaaccagagcttccgctgtgcactgtccatgcgtggggccgatcaaggacaccaaggctgtgcaatgacaggtttcttctctataaactttccttgtctctttcttttaagacattgaatagcactaagggataatttcttccttttcttttttttttttttgtgtgtgtgtgtgttttgatttttgacacaggttctctctctgtcacccaggctggagtgcagtggcatgaacatggctcactgcagcctccacctcctgggctcaagcaatcctcctacctgagcttcccatgtatgtgggaccacaagcatgccgcaccatgctcagctaatttttaaaatttttgtagacacaaggtctcactatgagctaccatgcctggcctagggtaatttcttaaagtagagctttatctccttgtcgagaggcatttagatgtcctttcttcaatgaaagattctttttctcctctaaagaacccagaaataatttgttggtcctttactatgatgtccctaacagatctaatcatgcctctccattttgagaccattcattctttcaaacaccattatttttattcagacagtgtacctagcaatagtcccggcactgggaacacagaaatgaaaagttactctctttaagaaattcacagttccaaaacctcggctgtacccacagagtcagggtcatagggaagtttcagtaccagatagtgggaggagggccagggctgccagtcgttggtgaatgtggtaaggtggcaggctgttggcagttgagagctggcatccagcattaaccttagaaacaaagagctcaaggagcagaaatccagccacagagactgggattcggtcataggacttctgttattgagaaggactggaagacagagctgggtaggaaccaagataggcatcccattacagcaaaggcttgtttttaggtggcagacaagggcacagaaaagccagcaggagtgactcaatactggttccctgaaccactggtcccaagcttcctcttgataaagggtaggcctggtcccggagtctgggtggagctgaacttcaaagtaaaggagggttaagtaagcctaactggaaaggttctgggccgtaggggcagacagccaagcatctcactgcagctaaaacccaagtaaaataaataggacttatggtatgcacaaatctctcataccagagaaagtggacattccaagtttgtgtgatttgaaggaaaagattttagttccgtggttcttgtaggttgttactagattgctagaatgcttataatataagatagttttgtgtgatgggtttatttgggaatgtgatgatagaaacaaaaggaaattcctttgttttttattaccatacaaggataagattttgagattatctttccaaggaaaacttatcaactatctattatgtatcaggcacaatcctttgtactgggattccaaagacaaataagatagttcttgacctcaaggaacttgtaattcgttggggaagacagataagtaaccaacaaattagaacgtagggtgattggagtgtgtttcatgtcactgcgccacagaagagaagcagttgacttaggagaggagaaagtttaatttgggccatgaaggaaattaaaagtaaagacctccaaattggtgggcagccattgaaggattttaggaaagtgatgtgctgagggatggattataagatcgggggcagaaagaccagttacaagggaaaatcatgctggtcatgccccagtacttacatttttctcataccacctcttagagcccctgaaagtgtagactccactatggagaagcaacacaaatgtgaaatactagcttgcgagccacgtgggtagctctttcctcttcaggaaaggggaatgctagtgtctagaagtgggagagattgaaatgattctgtaatgaggaaataagttacgttagggcacatatataaagaaacagcagaaaaaatgtaaaatctcaatcactctgtagccatgacatttataaaaatgaaaattttacaagagtatttctaaatgctttgaagttggcccccaaaaagcctgcctaccttcactttgagttacaaataaaatccctagtgttgcatagctgtgtgagtggtatttacattctcacacatttcagatctcttgagtccattttgctagtatttgttttccttggagataggagttaattcagtcacactttcttcccctgacaataactgcatttttttctctaaggtagctttccctccaaccgttgcttgttgttcttacccaagacccagtatctgccaaaacaaatgtatgtgagtgataaacgctgagaggaatgtctgttggaccacaggaaatttcctgttcaggaagagatcttgggaacttcctgtggaggagtgcattgtgggacttttggctgcagtcccttgaccacagctgcaattaactaaaggcagagggggaggggagaggaagaagaggagacagctacccacagacattcttatccatgtagcccgaggagagaatgggctcatacaggttcacaactttgcaagtgaactagatgtctagtgcagaacaagatcactgtgcccaacctcctttactgccatccatctttcacagccttcccggtgctttcctagggctcctaaaaacagtcactgtcacattatccatgtgcattccccagtccctcataagcacacatgaagtgtccatgccctctgtagccccaccaactgtttggaatctcttgattagcttctagaatccaggcattggagttggtggtctttctccatcccaacttaagtatgaaagagaggagaggagaacccgtggctctttgacataccttcatgtgaccctaaaagcattagggaaacgttatggaactgttacgaaaaaagaggttaataaatccaattgataagcacaatcaaaaccaacaggagaaccatgcattcttgtgctgcaatgccattacgaaatgaagtcctcgttaatacctcatactccccttcttggtccccaaactgggcacgtctactttgcattcaagtgcctgatgtgtgtgcgtgtgtgtgttttattttttattttttatttttttgagacaacctattgcctaggttggagtacagtggcatgatcactgctcactgcagcctcgatggcctgggctcaagtgatcctcctgccttagcctctgggtccctgggacagacaggcataccaccatgccctgctaatttttaacaattacttgtagagacaaagtgttgctatgttgcccaggctcttgatgtttctttacagccttcactcagtgcttttatggagtccatctctgaagagcagggcttatatttgagtttcaaaaatctaaagtctcagctggtggcaatttacatctgataatatatatgaccttggaagtctctggcagacataggaaaggggagtggacatctaaggactgaaaaatatcccaggccattttctgggtcatggaaaagtaacctgaccttcttatcccacctcctattcatcatccatctcacctcccatccccatcacattttaaattttaattaatttttcattggcagataaaagtcatatgtttatggtatacatacataaaacatgatattttaatgtatgtatacatgtggactggctagatcaagctaattaacatagccattaactcacatacctgttttttgtggtgagaacatttaaaatctaccatcttcataattttcaaacatacacagtgttattaaccataatcaccgtgttatacaacagatctcctgagcttattcctcccatctaactgacgttttgtatcctttgaccaacacctccccacccgcatcccttcttttactctgcttgagttcaacttttagattccacatgtaagcgagatcgtgtaatatatatcttttcattactggcttatttcacttagcataatgtgcaccagattcacccatgttgctgcagatggacttcaaaatgtaaaatattcttcatgagaatgaagttacccccccagaaagggggaccagttactccccagaaagaattaaaaagtagccgggcatggtggcacacacctgtaatccagctaatagggaggcttagttggggggatcacttgagcccaggagtttgagaccagtctcacagtctcagcaacatagccagaccctgtctcatatttttaaaacaagaattaaaaagcaagaatagtttgcagcaaacattttctgagacttttctagataatactaggtttagtccgccctccaaagtagtataattacatcatggttttaaaattaaaagcaaaaatataggtgaagcaaaagtgagctttattcatcgaaaatttgtcctcactcatcccatgtgactttttaaagtgtaattctaaggagactcccagcatccggatggcaaatacgtgaacagagaaacataaattaactggaagggaacaaaatagacctctcagctgaccaattctttgtagctttgacattggcctttaaaagaacgaggcaaacttttttaaagaaagttatctaatttaatgcaagaggtaactctctggctatgacttagggtaattaggcctattttctacattttggacgtgtttcctatggctggaatgtaaaagcttatttaatattgatgtaaccccaaaatttaagtaattggaatgcactatttctatcacattctattgagctgaagtataggttgtgctctgttcaattcaggttgtcttgacaaagactgagaaatagaatggccctccaagggcatacctgactattctgcggataacacagtcacgcaggcatttgctatagtgaaaatactgttatggttaagctagtggtatcttgtatttcaatgataccttacggtttaccagttttcatgtaatatattaacctatctcatttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcaggacgaccaatcttaagccatagcacaaaattcttaaatagactttacaatcatttcacctagtttggacttctggtggattattttgttctttgtcagcactccagcaaagataattactcctaaatcatgccttggattgaactgagctttgaatgtctccaatgttgggaattccgtaggttcccatagcagctctcctggcccagctcttagtttgaaagtttggtctcctaattagcctgaattttctctagtgacctataagcccattattgtaagccctgtccttattgtgtcataaaaataattgactccttgtcttcaatctatttcatataggtagacagctgccacatcaagaacgtcttgtaagtgcttgatttaccaaagtccatttctccacaagtttcttcatagttgttttcctggattgggggttattttagccttactttctaaaatgactggatttaatggaggcctctgtcagtcccaactctccaaatttctgccccagcttggtgctctttgctttgtttatagtaaataatcatttcagcatcagaataaatcagtgaactggacatgtctttaggtggacttttgagattatattcctggtccacattgcaaattagggaagaatgaaagaaattataattaactaggaagaaatttgtccgctgagaagtctcccttgttagactcctagaaaatagagaccataatattttataattttttgtcacagtttccatacatatttgttgaatgaatcctaaaagtcaaaagggagctgcttattggatttgagttgcttctagaacatgttaaaaattatgtgaattttctcaatgtatttgtaagaataagctgtcctcgtgattgagtattgatcttcaaaatggagaattatcagtggtgagtgatgctgcatgtaatgtacttataaaggataggaaaaatattttgtaaaaatgccttgggataagctttaaatataaaaatccaaaatggtgatttagtttggggcactcagaggaagaataagaatagggcctgtttaaattttttgcaacatgattactcctggttttacatttgattttgtattatagaatgagattaactggaatatgttataaatacagaaagtctgtcattataaacactagtcagcaccttttgtcttcataagaataattgctattttcaatgcatacttgctctaaaatagaccatattgatgtcataatatgtagactgagcaaaaatattattagtatcatcatcatcatcatcatcttctgatcttcatcaaagttgtattaaaatattttggtattctaaatatcattatcttttttgaaagcctacttagggtaatagaaggatcaggaactttggactctttgacagatttctagttttttctatttttttgctattctgtaaattctttcaaaagatttttatcaggtgtttactgcatactctgaagtgctgggatatatcagtgaccaaaacagatatgacccctgccttcatgttgcttacagtttaataggggagataagtgtctaccaaggaattcacactagccagagagcacattgcccacacagcatccagagtaatctgttgtaagataaatcagactgttacttccctgtgccaaaacctccactggcttccagtttcatttggaaaccttctgagttctcagtatgaactgccaggccctgtgtgatctgaaatttgtaaatctcgtcaacctctccaccctcatcctccatcaccttgtgttctgctagttcctcttcagccaccctgatctttttgctattcttggaacacacaagtttatgttctacctcagggcatttgcacttgctgcccttctgcctatgaagctgtttctccagatactctcatgttagagtccctcaccttatccaggcctctgcttaaatatcacctccttagagaagcttccccaacagcattatccaaacgacaccttccttcactctccatcacctttatcctgcactatttttcttcttggcaattttcaccacctgacatgtaattttttaaaacactggatggtgacccttaggtatctattcaaaatggccattcttgtgcacagctggggtatgatgccagtgggtccacctgtagggtaattggatgggcctggctgtctcatgggagactccagagtcttttcttttgggaaggcaagtttgtccaaaaagaaatcctgtgggctcctccttagaaagagtcaatatatgatggcacttgagcttttaccatgaagatttccactgagttcccctatattccagagctgctcacccttgctccctcctgaacttggcgttctcagattcatcctgattccagcaagggaaatgtcctttcatctgcaaggaggtgcaggttgctgggctgggggagggtggaatacagccatgccacagatgctttattagtcttctctgttccctgcctgccttcagaggcacttggaacccccagtttctgaggttttatgaagttctggtaggaaaacgagtttgtttattggtatctccccctgcaggcagattgagttaagattttctgctcagctgagtcagataccaattgtccgtctgttccagcttccaaaattttgtgcacctccctcaactgccattgtttcctctcccattctgttgtcttgtgggtttgtaccttttttattcctctatctggtttagtgggacgtcagacaggagcagggatagacaagatatgtctcatcaatgtagttacatgtggaggtaaaagcattgatgtagcagtacaggatgctttgaaagcataaaatacagaaatctggtctggtgtgtcgcatacatttaagaggagacttgaaagctaagtaggagttaattgggcaaagaagaaggtaggattatttctggggaggggaacagagcctgtgaaggccctgagactggaagaggatttgttctacagggaatggaaagcccagcccaactggcattcattgaatttgctgtggaaaagcagagtgacacattgctttggtgaggattgcagatggtgaggtagaacaagacagtcacgttaaggattttgatctttatcctaagagcaacaagcatccgtgtctgtgttacctcagtaaccttggacctcgtaaactctgggttcttttataaaccaggcacagtaatatctacctcacagagctgtgtgcattgcatgacatcatatacacactatattgacttaagactgtcatatttgtttgctcaactcatggatatgaagggcagactgtataccttgtcaggtacttttttctttttattgtatcccatgggggaaatggatggtagattggtggaggtggctagaattgtaaagaaaaatatgaaattcacatgaaggctggagttactcatatgacaacaacagcttatggggcccaattctattgctcttgcgtctgtcacacagttgaggttttggaatgaactacgtatgccatccttgttggacagtgacaagtcactgtagccccctaggagaagaacagtataatcaagatgtcaggttgaggaataatctttgtgatcaactgagtgaaaggtacaaagtaagaaacaattgagaggcattgctctgggcccaaaagtctagtaacaggcaattagaggttaaaggataagcatttgatagtgttctagctatactgcaaaatgaatgctgcatgaaggctaactgagaagcttatcagttggtagttgggaactaaagaggaagcaggcaccaaggaaagatggaaagttctacacacctttgttagttacacatggaggtaaatgcattgatgatgaatctgccatttttaggttttcatgtttaaaaagtttcctgacaatgtgtctagcaatgtgctagacactgtagataatatacaataaaatattaaagaggcggctcgtcctcaaggaactttcaagcattcatacatttctgtttgattgtaacatatttattattttaaagaactggccagagagttgcatgttctgtgtagggataaatagcaagtttcaggcccctgcatttattggcacttacgtacatggtagtcctcacacctttgccggacagcaccaaaaatcctgcggagctcaactctgtgacctcaccctttgagcctggaaatcagcatgaactcatgatctgacaatcccgaacaagctaagcatttcttaaaagaaagcagtgacttttaataggtctcactgatggtgttccaccgattaaatcagtcaaacagaattgtcacattgaagattatcttgggtttctagaattcattctaggttttaaagatgcagacagattctgagggtcacaaacgtcagtttgccaagtatgtttaggctgtaaagttatccatgaaaagaccgtgtggtttgcatgagattgattgtgatcggatgtaactacattgctttttacagctcagtagaaaccactttcaattgcaaattgtagcagaagcaggcgtctacttaattttgatcttaaagaatttcaaagagaataaatgcacactaaatagtggtggattttggtagtatacgccaacatcactttttatttaacacatgcagaaatgtgtactggtagagaaaattggtagagtgaattaaagtacagacagatccacattgactttaaatgaatacatgcacggtcagaaaacggtaaccctgggcaggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataataaaataatatgtaaaggctaaccaaataacccactttagtctttacttactggcaggcagcaacatgtcctatttacagagggaggctttacctaagtggttatatgtaaatgaaccaccttttcaatgaaacaggatgcacctgtctagaggtgtctgttactagagcaatggatgtttgattggactgacaaattttatttcctttttggaaaaaagaatgtaggtggtatcaaatcaccctttctcctggtaacaataggaattacttcttgaacttgagaaaccagtagttgcttgacctatgttttttgcatttagcatagtcttctaaagtagtaggagcatacgtttttgtctttaattccctgcagaccccttccccaatgatcatcagcaatacatccacccataaatcaatgaaatcataaaaaagaaacataaaattcacttgaaaaagaatacctacaaggcattcctagaattctcaatgtaagtcattttttgccagcaaagctaattgttctcaaatatttgataacaaggatggcatacgtagttcattccaaaacctcaactgtgtgacagacgcaagggcagtagaattgagccccataagctgttgttgtcatgtgagtaactccagccttcatgtgaatttcatatttttctttacaattctagccacctccaccaatctaccatccatttcccccatgggatacaataaaaagaaaaaagtacctgacaaggtatacagtctgcccttcatatccgtgagttgcacatccgtgattccatccagccacagatagaaaatattcagaaaaacaaaaaacaaaaaaaaaaaacccacaaatgcaacaataaaaaaatacagactttcagaatagcatataacaactatttagatagcatttacattgtattcgttacaagtaatctagagatgatttaaaatatacaggaggatgcacataggttatatgcaaatatacaccattttatataagggatttgagcatccttggattttggtatctgggcggggggtcctggagccaatcccttgtgtatgcagaggaatgactgtactggaaagcaaagtaaagctacaccaaagagggtaatagcaggctataaagtactgagagaaactaagagaagaaagtgaggtacctctgacaaaggagtgcttggaagagaaaggatgaatagaaaaatgggatttcagggaattcattgatgacaggatgacctacttaaaaatgacaagggccatgtgtggtggctcacacctgtaatcccagcactttgggaggccaaggtgggcagatcacttgaggtcaggagttggagacgagcctggccaacacggcaaaaccctatctctacaaaaaaatacaaaaattagctgggtgtgatggcacgcgcctgtagtcccagcttcttgggaggcatgaggtgggagaatgacctgcgctcaggaggttaaggctgtggtgagccgtgatcgtgccactgcactccagcctgggtgacacagggagaccctgtgtcaaaaaaaaaaaagataggaagtgagcaaaagagaggtcatagataatggcatgatgaaacagaggaaaaaaaggataagaaggaggaagaaaaaatgtacaataaaacgagaaggaaggatgcaaaatgaatataggaaaaacaagagaactgaagacaagaggaaaaaaggagatggtagaagggaggaatgaaagtaagtaaaataggaatgaagttcaagatctatttagccatagctaaaggaacgtattatcagctattgatttcctcttctaataaagaggagaatgatatggatagtccagaataatggatcatttgcaaaacattaatgtgtcttgacttaaggtacatgtttataattacctcgaactgtatatttgtcttcttccatgtgtggttttaaattattttaccaaaatggggaagccaggagatacatacttgattcagtaaaaccagctttttattcgtagtttacttcctgctgcatccttttttcggctgagagggatcaatgtctgcaggtgtcccttaatccataattaaaccatatgcacatctaccctcccagtttccctgcccaccataaaaccttcatcttggctattgcttggaaaatggggagggaatagagcttctgcttttttttttttttttttttttttttggagagagtcttgctgtgtcacccaggctggagtgcagtggcgtgatctcagctcactgcaacttccgcctcccagattcaagcaattctcctgcctcagcctcctgagtagctgggactacaggcacgcaccacaacgcccagctaattttttgtatttttaggagagacagggtttcaccatgttagctaggatggtctcagtctcctgacctcgtgatccgcccacttcaacctcccaaagtgctgggattacaggcgtgagccaccgcacctggctggaatggagcattttacttgagacctctgtgagctggtcctgagtatgagtagtgaattccaacccacttttctcctaatccctgtcgtgtcctagagtgagaatatacagaggggttggaagtgggtttatgttcatgggctttctagatggactttcaagtccaagtagaagtccaacttgagagctcgtgtagaaagcccttgaatgtaaacccgtgaagaaaagcacttccttatttcagaaagagcacaaaagaccagcaatccaaaggcatttcgaagaccttgaaagagctgggagtggcttaggtatggagggtgcatgtgtgagtacaaatggcccctcagctcagaaccaagcatctgtgtgccatgatccatggttcctaaatatcatggagggcaaaaagtataaatgtgaattaatgcaagagaaaccacactgaaataaaaaatacctgtggtctcttgagattcaagttggcaaaatccaatctaaaagatgtctgactatcacaattagtgaagtccacaggtcagattttcctctctgttcctgattaggattaacctggaaaggtggattgggtccatctttaataataactacaccttctgaaagatttgaaactattattatctctttgtttgctgctgctttcatagatttatggtaggacttggggttagatggatgatccaggtcacctattccagcctcacactctgcctctattccaaatatgacatcactgagcgatggccacccaccttcccttggatacctctaacaatgggaatctcactgtttcacaggcagctcttttttttttaaacacctccaattccaatttttaaacacctccaatgtccagaaagttctttaaactcttaaatacatgacatttattaaaacaaagcctcaaaccactttcagagtggtggtacagcaaataattgattcttttcagggtttttcccccctgtgttttttgtcttctctaactcaaatcattgcccggatattgcttataacaggagctcagcctcaaccagtctttctgcttttaccacatgctctagtggaatctagattaccggactcatttcgaatctaactaaaaatgagaaatgctctgtttatataaagcttggcaatcaataggaaaaggaaaggctgtttagcaaaggccagtgataattccaagaagcagtgtcttttggaatatgctatggtgacctggccactgcagctatctgcttatctgtctggtttcagatttccagaaaggactcgctgccttcgaaacacttcccagcccttccttgggtgcctggatttctaccattagcagtttactccttgagcatggatttttgcagaaagacatgtagaccagggagatggctcattaagctcttggtggtcatttcaccagagcatttagcatttttaaatcccttcctggatgcttgttttagtgatgatggtggtggtgagatgaagcagggatgtgtagatcatgaagggatgggaaaggggatgatttggttggaacgaagcaaaataacatttctgagtgcctgctaaggtccagcacttttcacacgtaaaattttcacaacaatccctgtgagttgggatccagtttctacagatgaggaaatgaagacaggagactagatgacctgaccaggtcctaggccagtcaggaacagagctgggatttaaaccagagctgcctggtccaaaacctgtgctggtcctgctattttatgacacctagaagggaaaagggcagagaactggaaagctgagatggaatcacctacttaagaattttgcagaaggctaaccctgtctaaaagcatcgctttgcaatcagacacatgtggcagtaaaaatgtcccaatgctaactcattttaagccttggttttagtctacctaaaatttatagaacactgtaaaatatgctacatgtaataagatatttattaggagtcttcttgcacttgttcagaatgctttttattatgtttctgctcattattgtagatattctcccattttggagaaattgaccgcgtgcacactcttcactggagttttgcacaaatcttaccagaaaactggtgaagatcagtcctgaggccccttccgcctctaattccttgcagtattttggctgtactatgtgctgttacactagatcacaataagcagctgccagtttcctcacaggttcccttggggaaggatatgggaataattcttaggaaccccccacaaattatagcaaccaatgcagtaaaacccctttagctcactcctccccctgtgctcactcacatactcaaatatatttagtgctttccttcctctcactccgacacttttgggagagccctgggggtggttgagtaccttgtccttgggtggattttcttgttttctgagactggctgccatcagacttcgggagaggatcttaccagaggcgggtctcttcttcccccgccaccgccctcagtattctttcacagccaccacaaagccacgctttctctgctaagtacacattcctaggactgtaacaaaaggcttctgtgagtttgaaagctgcaggggaggctcctgcgtgaaggcctaagatttaaagggtttcatttctcctgtgctggggactgtattgagtgcagtttgaaatctgcttcaccaccacaaggggaaatagaaatcagccctaaagctgcatggagaccccggctggtctttatcctcatagcttagtgatttcctgccacccaagaggcagtgaggggctccctgacattccggaggccccaggaaccctggctgcggtgacccggtgctggggagggagtgcatggggtaggctcctggttgtgagccttcagttcgccgggatgtctatgctgtgctgtgtggctacttagccaaggctgtgcatgccagccggagccaacagcttcagcaaacctgccctccggggagagtggatttcattgttttcaaagagatacaggaaatcagaattttccatccttccatggagagacttggattggactgagaagagaaccagcattaaaaaggaagtctccttccctttcttccctgcccctcctcaccccagccccagcccacccgccaggggcacaccctccctctgccggcctttgggtggaaaccttcctgcctgcagcacaggcagtgtgaactgcggggctgtctgagcaacccagctcttgccttttcagtagcagaggtaatgtggccacgactcagaattatgggaccccagatgctgaggaagtaaactgacttcttttcagctcacagcagacgcatagacaacagagtagatttcatgttctaatgaaacagtgtagaaactctgtccttggtggctcagtactgtgtggtatgagcctctgcctccctccctccctccctctttccttctcttttcctcccccaccccttcacggcctgccctttcctgattcttcagaactgacaactataaatccagcccaaattcctttaaacaaagggtcaccaagagcacgaccttgaaaagacttcttgtgatatgcacttgcagagttgcatattgttccttggatttaggacaggccaaagaaatcttccactttatttaagaagagcctgtgtggttcgaggccagggccgtggacataggattaaccacaataataatacaatgaagtacacatgcaaaatgaaaacttaataatgaagaactactgattttttccagggagtatcaagcacttccttgtaaattcttacaaggcatgaattatttcctagaaatgatttaggctcttttggaaaagtgcattgattcttttaacatcataattccagttacggtaaaacctccattatctgattttctgtgaattgcaaagctattattaactggtacattttatattttaccagtacagtgacagctgatatttataatggtgaccccaaagttctgtaaaatgccgaattacccactcaggaatcaaagaaagattaaattgtgttaaatagagtttttcatgttaagtgtcttattttattcagatcttgttttagaaagtccaagtgtacatccaccataattttcgagggcagtaccaacttaaaatgttttatcttttcttggctttgtaaacaaaaccttgtaaaaaaaaattttttttttcaatactttgggttcaaactacagatcattcgatctcaaacctgacaggtaaacaaatttttttttcagagtaagtattgcagacatgaaagatcataaatgtgttcaccaaagtgagtgtgagacagatcaccccaaacactctccactatttctctatgatcttagcccagctgtgtgtgttgtgagtcatgcctgggtctgacaccagcattcagaggctggcatagcttagcatccacatcataaagggctcagatcgatggctctccttgtcaagctctgcagccctctctcaggctttgtgagatgtggtttgcatcattttcctttaaggaaatgttatgcagaaacataaatgcagtatacaacgaggaggctttcaccaagaaattaaaagggtacagatgtctaggaatgcaggggttaagacaaaaatgtactgcagggaaagaaatgtgagcagaatgcccctcttttcgcctgcttctgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgattaaaaaaaagaagttactcccactttccagatgagaaaacaaattcaaagacagtgagtgccttagctgagtcctatccaagcaaggcagggggcaaagccaggactaaaacacaaggttctaattccttctccatgatttcctgatgcccatcataccctaatagaataggatcaccctgcaaggcaactggtccacatggagagtcctcttggaggacaccgacccgtggtgccacctctgatttgcaagttggtgcattagacaagccctggaatgacagccagaagatctctattctgatcctggccctccgtctacttgggccactttgatcaagccatttagccccgttcccttcaggtggctcagctggaagtaagaatgataatgcccatgcagctgactcacctggtgactgtgaaggccaaatgagatgatgtgtttgagagcactttgcaaactgtggagtattgccagccatttctcctaatttggctcagggcagaaagacatccaggtgaagagcttgatgtgtgtgatgacttaggcttggggatatttgtgaacaggacacaacaaataaattcgtttgacgggcagagggacagtatgctgggtatagtagaaactcttggaacctgcagttattgaagggtttaaaactcaaaaatgatacagaaggcagttctattacagtttctgcttttttgctgttcaacacctctgaagatggtgcgtttaatccttcctgggatggcaggttatagatgacttcatgctgaaagtgacccgtaaggaatatccgtatattttgaagtgtatgtggttcaccaggcagaaaacagtctgccaagtctctcatcccaggcagaaggggtggcacatgcgaaggccagagaatgcagtgcctctgagaactgtcagatgtcagtgtggctggagccaggtctgctagagggtgaggttggaagttaaccaggagtttaggaggccctgggaagcctctgaaaatatttaagcaaaaacagttagctttatgtttttgttgttgttgttgtttgagacggagtctcgctgtcacccaggctggagtgcaatggcgccgtctcggctcactgcaacctctgtctcccaggttcacaccattctcctccctcagcctcccaagtagctgggactacaggtgctcgccaccatgcctggctaaattttttgtatttttggtagagacgggggtttcaccatgttagccaggatggtctcgatctcctgacctcgtgatccacccgcctcggcctcccaaagtgctgggattacaggtgtgagccactgcgcccggccagctttatgtttttaaaagatcattgcctcgttcttggttctcagctctctgatccttttagtttttattggatagaggagagaccttaatgtatacagagactaaggaacttggaattggaaatctgcctggctccctttccctcaacgtgcctgcagtcagccatctttctccagctaagccaaaggatggtgggggcaccacacaacagagagctgagttagaaagggtgggagggaggtggctgaagggtccccactgcagttgacaatttgaaataaactcccactttccttcaatattttcctatagcaaatggaaactttgaccagataccagcttctttccatccttccattagactcacagcccagttaggatgttcacagtcccaagccagggatagcacatgccattaccatagtgggctggatagggggcaggaagcaatgctttccagcccttagaagcctctggtgatgtgctgtgaacatggtgagggaacccgaactttagagtcaaacaggctggtctgcaaaccccggttccagcactcactggactcaggatcttcccaagttagttaactcctctgaccatgtctgcattttctcatctggaaaatgggaacagtaatatccaccctccagagctgttatgaagatgaaattgaaagtgtctccaacgcaccaggtatatagtataatctcaatttatgcttttgcccttagatgccagaagttaatattctttcaatacttattctcgtagaagcaaaagagatcctgtttgtgtgatgttcctacagcctctgctgtactgtattatgaaagctcaagaaataggagttaatgatgaggcacagcaggaagaaaaatgtctctaagatgccaaacagggaaaatttaggaagaaataagaaccaaaaaataaatcagttgatcagggtaaaaaatgtcttatgctctgaacttataactctatggagtaatttccactaatgatctcagtgtctacttaactaatcatgtacttttctagccagaaagacagtacttgtagggtacgttccattttaatgcacaaatcattgttgcttttcaaaaagtcatctttttttccctggccacacacagcaccccgaggcctggccagcccccatgccagctcaagagcatgaactcttaccggaatgggttctgtggggagtacaaagtcaaacataagtaggcttgcattcagagctcactgcctagcgggaaaaaagacatatgcactcataactctaatttaacacggcgtcctagaaattccatatccatcttcaaagttctctggaagcaaaaagacaggaggaaagacatttttagaaggaggcttcctggaaggagtgacttcagtttcaggccttaaaggagatgtgagtttccacatgcaaggagggaggaaaagcatgttgcagacagacgaagcaagtgtgtgagcaaaggcctgcggggtgacagggaggggtgttgggaggtgtgtatctggatgaaggcaggtatggaaagtgctgggaaaaaaggtctgggaaagggccttgggggccaggtgataaggaagttgaatgcctctttgaagagtggggttttattttatgtgcctttggtggggagttgtgaaggtttttattcaaaagagcagtggggctgggcacagtgactcacacctgtaatcccagcactttgggaggccaaggtgagcagatcacgtgaggccaggagtttgagaccagcctggccaacatggcgaaaccccatctctactaaaaaatacataagtaacaaaaattagctgagcgtggtgatgcatgcgtgtaatcccagctatgcaggaagttgaggcacaacaatcgcttgaacctgggaggcggaggttgcaatggcctgggattgtgccactgcaccccagcctgggcgacagagcgagagagactctgtctcaaaaaaaaaaaaaaaaaagcaatgggaatggttcttaaggaagatttctctgggcacactgtatgttctcactgaatatttggtgtggtttgggttttataccagttacgatatggggcttggtatctctgagcctaaaatctgtgctttccaaggacagtagaaatgctagtgttcactttgctcagtactcttccctccacttggcactcatgctgcttctcaagccttggggtgtccctggttctggagtccctcctacccctgcagcccttttctaagctatagtctcacccctcctctgcaggctcccaggcagcctcacctcctcctgcagagggatcagctgtcaccctgctcctccctcctggccctcagcctaccctacccacatgcattcaccatcttaccagtggaacaggcgtccctctcctgtatacagaggtcccttcccctgagctcttctgcctcagcctccccagtgggcttctcccctccttcacagtcagcctctttctcatttgcacctagttccattccatcttcaaagaagcccacttggattgcacatctctcttcactaccacaaatctggttcctcacagccaagttctggaaagagttctccacatggtgtcctcctcctcacctcccattagcgcctcaaccctccgtgatctggtttctacgcctgctgcccctctgccctggctgcagtccccagatgccgaatccatctgccatctgctgcccgaaactctcctggcttgcaagataccactgtcctctgacttgtccccggtcttgtcccctgctgttccctcctttaagaatacaccttttctaaattgcctgctgcctaaatgttttcctctggaaaactcacctactccagcggcttcaacgatcatcagtgcgatggggacttccaaatattttttatctctagcctgggcctttctcttaaataacagatgcatgtgtacaactgcctactgggcctctttacctagatgttgtacagttacctcacattcaacaaagctgaatatatcccccgccaatccatcctctgtgggatgagatgggcgggcccctctattcatctagtttcaggaatcaggagcttggattttgtcattgactgcttcctccacattgaattaatctcttaagttccatcaattctaccccatggtatcttcagcccatcctttctccatcccttctgctttagttcaggctaacaatatctgtcatctccatttctgcaacagcctctgactggccgccttgtaccagtcttgccctgttctaattcattctctactctgcagctggagtgatcctttgaaaacaatatccgattatgttacgcccttgtttaaaattcttcagtgactccttgtagccttaggataaagcctgaactccttagtacagcagacaaggccttccaaggccttcctaataatagctaacacttatgaagttcgcaatccataccccacactgttctaaggtccttacacatatgtcaacatacttaatgctcataattcctgacgtaggtcctgttactatccgagttttacagtggaggaaatcgaggcacagaaaggtaaggcaccttgcacaaggtcacacagctaggaagtgggagaaccaagattcaaacccaggaaacctgactccaggcccacactccttagcaccatgctgcactgtctccatcatgtgccgtagcttctcatccattcagaaatattatattgagtactgaaaatgggctagaagctgcttgagacactggggatatagcaggaatccaaacaaaggtccgttcacatgctagtgaagaaaatgagtaagaaacagcatgattagtaaaattattaggtagattagggatgaatgctaagagaaaacaaaaataagcaagaaagaagaccgggggagtctgagaacagatatgcgatgttagaaggagtgtccagggaggacttgaaggaagtgaggatgtctaggagaagaatatcagctgaaggaacagcaagtccaaaggccctgaggtgggaatagttcctggtaggtctgaggaacagcagagaggtcagcgtggctggagcagaatgaaggagggaaaggatgatggcaggaaaggatggtgggagctgggtacagacaggtcaggtcatatagggcccagaagatcattgtaaagaccttggcatgaactgtgagtgagagataggaagccactgggggattctgggcagagtgacatgatgaaacttacaaacagaggagtgatgtgatttgaatcaatctctggcaggtctgttgaggatagatgcagggaaggaacagtggaagctggcagaccagtcagggaccagtaacaatgatccaggcaagagaggatggtggctgggactaatgtagtagcagcagaggtggcggaagtgggcagagctggatacatttggaaggcagagccaataacacttaccaatggaccagaagggggtgtaaaagaagaaacaaggggctgggcacggtggctcacgcctgtaatcccagcactttgggaggctgaggtgggcggatcacaaagtcaggagatccagaccatcctggctaacacggcaaaaccccatctctactaaaaatacaaaaaaaaaattagctgggtgtggtggtgggcacctgtagtcccagcttctcgggaggctgaggtgggaaaatggtgtgaacccgggaggtggagcttacagtgagccgagatggcgccactgcactccagcctgggcaacagagtgagactcagtctcaaaaaaataaagaaagaaagaagaaacaagggcgactggaaggtgtggggccttggccacagaaagaatggagtttgccttctctgtgatgggaaagattgggaacagcagatttagatgagtgacatctggaggttggttggcctcattaagcctaacgtgcctattaagcatcaaaatggagatgttgaccgggcacagtggctcatgcctgtaatcccagcactttgggagtctgaggcaggaggattgcttgaggctagagtttgagaccagcctgggcaacatagcaagaccccatctcttaaaaaaaaaatgtgttttagattagccgggtatggtggctcacttgtagtcctaaccacttggaaggctgaggcaaggggatcacttgaagccaggagttcgaggctgcagtgaaccatgatcccaccaccatacaacaactctgttgtctgggcaacagagggagattctgtctcttaaaaacaaacatggagatgcattgtcacctcccaccctcacccccatttgaacacacactcacatatatctcacgtcctaatcctactgaactactcaacatttccccaaaccggttgtgctcttttcatgtgtgcaggccttgcatccgctgttcctctgactggaaagctgttggcccatccagttgagaaagtcttccctggccgtgcacgaatgcactaacttgtaaatgtctctttacattcctttcttcccttccagaccgcaaaatccagtctcattcaccttgacatgccctgcgcctgatccgggacgcgaggcatagtgggcatctcctaggttagacggatgggtgagtgggtgagtgaacggagaggtggacaaaatgagtgctcagcagttagacccaactgtgttttgatggtagtgatgggaattcccctggcacatggccaggtgagatgatcattcagcctgaaatgaaagaaacagcagatgtcaggaagtttttgttaatcctgccttgtgcgttagaactctcccgcatacgtcccctttcccgcacactctctctacctttctcccccatttctagctcctggtcttattcatctgtagcatcagtaaacatataccctttactgttcacatccaggtctgtaggggaaattttggttataaaaccggaagagtgtttaacctaatgtcctgctgcgggcttgctttccacgggcctccgggtctgttaaaatgatcaggcctcattatttaggaagctgcctcagccaggcattactaatttgggcattactaattcagatgcctattcaggcaaatgagcaatgaatgtaaagtgcttttgtcagtgaattgcaagtgaagagaagagggagtgggggaagtaaagggaaagtgatagaatgtttgagctttgcttcatttccagaaaggacagccattgcttcctggaagctgggcttggcaacaggcatggaggaatgggaaagatttatttccctttgccaaagctcaataattcagcttgagtatttcaaatcaatacatttcttgcaaagtttccaagggctgcattaaaacagccatttttaaaaattatcagtacatgacagcatcctccgacgagactggcatgtcagggatgagtcgagtcttccaaatagacaagactccagtgagaaaggaggctgccacaagcaggaaaagcgaagttagagctgacagcaagaccaaccgcacctgtagggcctctggcgttcacacacctcattggttttgtgggggctctttctgagatgagcagctggatcgctcctcctaagggcttgcatgggggaatctgtgactataactccgtatttctttgaagatgcaattcatcactgaacttgggaaagactaacttggggaggtctccaccacgatctaggattgctaagatgtctgacaggctgagtcactcatacttttgtgaactattaaaaatttcatagttctgacatctggacatcttgactttcggtgataggagatatggaaagacagtaaaaggctgtgtctttactgttgttttaatccccactagagagtcctttttttctttttttttttttttgagttggagtctggcaccgtctcccaggctggagtgcggtggtacgatctctgctcactgcaacctctgcctcccaggtggaaatgattctcttgcctcagccttccaagtaactgggatgacaggctcccatcactaggccaggctaattttttgtattttcagtagagacggggtttcactatgttggccaggctggtctcagacccctgaccttgtgatccgcctgcctcggcctcccaaaatgcgggattacaggtgtgagccaccgcacccggccagtaattccttctatttcgatgtttcatcttcactagaatcgttccttagttctttcggtgggagaagccattcagccccccttgactgccagtgccctttgaggctctcagccatttgattcttcctgtgtatcccctgtggttgttgtctctgtttctagagtgcagtggttcctgcactttgggctgtaaccccctttggtggggccagagaccccttagattaattatcacatttctttcacttactgccacaaaacccagcagcgattcactaggagaacccgaagattggtgctcttctttatgagacaccaaaggggctctgtgtttcccagcatgaagtcttcagtgacagagtctgggaggacagcacaggcagcagcagtgtaactctcagaatccccacggaagagcagagcagctcaatagcaaaaccaaaacccagcgacgagacatccccaagtcccaccttaatgggacttttggtagcctttggaacagggaaaacccaaaaatagccaagaggtattcaccagaaagcctgaaagtgggagtggttttgctcgttcctatagtagtgagggcaagtggcgtcgaggaggtctgaaaggtgtagagttctctgggccctgtgaactctgccactaaccagccacgctgatggccagctttcaggatagctgtggagaagctgctgggagtagaggcacattgaaaaggttagggatggccaggcatggtggctcacgcctataatcccagtactttgggaggccgaggcaggtggatcacctgaggtcaggagttcgagaccagcctggccaacatggtgaaaccccgtctctactaaaaagacaaaaattagccgggcgtggtgatgcatgcctgtaatcccagctattcaggagactgaggcaggattgaaccctggaggcggaagttgctgtgagcctagatcgcgctaatgcactccagcctgagcgacagagcaagactccatctcaaaaagaaaaagaaaaagaaaaggatggggcagcagagacttagatgcaaggtctcccaaaggaaacagaaccaggagatttcagaaagccagctgccatttatttgaatgctacatgaaaacaatagaagagagggtttgctaaggctggaaccatgccatttcataaaaatttcggaacattgtcttcagatgaaaatgagcaacagaaaagtagtgaggtcaaatcccacacaaagtttttataagataaaggaacagaaggagcagaatagcatccctcaagaaagcgtgccaaaacaacatgcctttagaacaattcaaaaccctacttacctccaaatgagctaaaaggtaagaagaaaaagatacgaagcgtggggcaaacacaacatcaatcagaattagaaaaacttccaaatgaaatgacagactctggaaagaattaaaagtaaaagaaaaatcatttcagaaatgaagagttaactagtgagaatacaagatgaatctttacaaaaggtgattttttaaaagagaaacacaagggggaagcaggaaattttttaaagaagaaacaagaaaggttttaaaaacaactcaagaaaaagtgacaaatattgaagaacggcaaagaaatttcaccacgtggataataggagtctctggggaaaaaaccacaaagcaagctttcgcctgcatcgctcctgtctctgcccctgtcttcacatggccatctcctctcctctgcgtctctcctctgtttccatataaggacacctgtcattgaatttggggcccacctgcataatcttgagatccttaacttaatgacgtctgcaaagagccattctcaaattaggtcttattcacaggttctggggattaggacacggacatttctatttggcagccaacattcagccatctccagtcactgagctagtaagtgacaaaaacaggatttgaatttcgttgtttcattttattataacgtggttaagagagattttaaatatttccattaagttagcaattcttgccaacaacagtagaaagcatgcctttttttttttttttttttttaaagtcagagcctcattctgtcacccaggctggagtgcagtggtataatcatagctcactgcagccactcctaggctgaagcaattctcccacctcaaccttctgagtagctgggacttcaggcatgcactaccacacctggctaatttattttgtttttcaaggagatggggctcttgctatgttgcccaggctggtctcgaactcctggcctcaagcagtcctctcacattggcttcccaaagtgctgagattacaagtgtgagccacaggacctggccaacagcatgcttttacaaatagtagggtagcaggaggccagcctgcagaccgcccagagacctcaccccatcttacgctctgcccaacctcaggggagcatttttgcacttggtggattagcattacttgctccatccatgatgagccactcatgctcttcacagattttccagactcccatgtcaaagttaaaaaacagacatcggcctctttccagaactcagaatattcacatctatattgttaacactcataccttttccagcacagaatgaaaagcacctttgaagaatcgtaagccatgaatgatgacgggccgaagggagtgagggctcctacctcttgtcactcctaccatcctgcctccaggacccctgccacctacttgggagtctgcccttaaaactcaagggtcacctgactcattcctccccactcattcatctgactacccaccaaagctaagtgtgaacagcctgtattgatttatcattttccttttgcctgcttcctctggtacagagatcttcatgctttcatccaaacgaatgaataatgtaaaatcccaggtggggtgacagagccaaggagaaaagtgttctgcagcaagggagggcctcccagtatgagccttggagtctcagataagcccagggacaaagcatgagacatccagttacatatctgtggccctggaaggggagacggggttcgctttgtggtggtgtttagctttcctgactccaagtgaccatcttaagccaggggattagtaacctttacaactctaatactagggaatatattaataactggtgagaaaaaagattacagcttttttattgataggtctataaaagccatttccgtatgaatgtcctcagaaaggaggaataaggggatgagatagaatagaatagagagaagtctgtctcacacacacacacacacacacacacacacacacacacacacaaatgcaacacaattatctttaaatagaagttgcttctccaagtttgtttttttttgtttgtttgtttcatgaggcgtcagcaacgctgttaaaatgatttcatcctgcctgtgtgtcacagcagtctgccccgcgaaatgctgaatcagcagcagcccagacagcctttcggtggagggtagattcgacacccaaaggcaaccaaccgggcctttgaaagcacttggaagcactctccaaagagccagggaagaggacaaggaagaagggggtgcagtggaattctccttaaaaaacagcatgttctagaaaagccatgctttggaggtgctgtaggtcagatttgcctttgggtccctatgtgtattttctgaggtctgttcatgtaaaagttcaacacctctttcgcactcccttctcccagcccccgcgccctgcccccacacctcctgtccacctccacctcctcctcctggaattcagtgattatcaggactgtctccatcctgagaagaggctttttaaaatttcgcaggagaatagagacacccgagagggctgggaacaggcacagctgagccacacaaagccaagcctcctccatgcaagtgacggacagatcaggtcccagttcagaatgagaatgagttttactctggttacactttgcacaggaatgttctgcagactgtgccgggcaccagagatggtccgtgtgcggtttaaaagagcaggaggggaaagaattttcatccctctttattcaggcaccctcaggagagtatccatgttctgtgaatcatgcaaatcctgcaggatctttatgttctctgtaccccatccatttctgctgaggattacaaacattcttgcaccaactttcctccagcagtttcgatttctcaataaatctgtttgaggaacatttcaactcttaatatctattttcctactttttttttcttcttaaactcaggcttctttgtaagcatacatatcagtaagtttgataataaaaatgacctttctgccctgcagtataggaaatgctgccttaatgcctctttgctttagaaactcatccttgtatagtatctctccttgcatagccaagttgcctcattgtacgtaaattaaggttatttgcagtgattgaccctaactactatgaagaaaaactttcaatatgttagcaatgatgtctataataactgaagaagggacattccctatttaaggtcaggactgtgcgtttcaaataaagaaatgacagctcaaacatttcattgtacccccacttctaagtgagaagagggcacccttcgtgtctctcttttctgtttttctccctgaaatatcaggagagacatatatctctcttaaacctgatttggttttcgcattacctcacaggtacatattgtcagaactatttgcatacacgagactaaaaaaaatactaaacggattctccagggatccatggataaacttgaggtagtctataagctttgaaatcacaagcaaatatttgtgtccatgtgcctgtgcattttgaaggggggtttgtttatgaactctggctgaattctcaaagaatcctgtaccttcttcctaacgctgagaagtacttgctctaatctcttccccactccctttttgctgtcccctccccattatcttttttctttttgatatggactttaattaaaatgttgatgcttacgtcaccatacattttctgcattaattttgatttttaaaatattgcgttacatgacttaatcttgattactgaaactttttaaaggtaccccttaaattttgctcctggggcaaatgtcttacttgcctcagcctagcctggggcctgagcgggcacctccttcagccttctttcctccaacctctccctgatccaggctgttttccgcaaccccacctgagccattttcccagcctgcaagatgacaattcagtcccctcctcaaagcactgtactgggcctcatagctcctgccagagccgtcatgcaccttccaagaatgcttgctccagcttctgcagctccagggagctgctgaaagtattttggtcttctggagacacgggacaaagtacaactcatctactatccagtccttgtcctacccaaccccccaaaatgcattgagcacttgctctgtaccaggcactgtgcaacatctctatagggatcacctcatttcatgctcacatttgccctaagaggtaagtactattctggactccatcttaccgctggagaaacagattcagacgcgtaactaacccagcgctagtaagtggtgcagccggtgttttaacccaggacaatttgactgcgaaacccaaggtctgatctaaaatgctacatggctctcaccacattgggcttgctacccagaagcaaaaatgagaagaactcttctaagtcacgtttgtgaggctgagcggcaagctctgggtcagttttgctgtcaacaggttttctgctaaaaacccgtttgtagctaaaactagataaaagtcagaaaaatccacaaaatgaagtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaaaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaagcaatccaccggccttggcctcccaaagtgctgggattacaggtgtgagccaccacacccagcccttaaatagttttttaaatataaaagtaaaacatgcttaatagagaatgagaaataagaaagaaaaaaggaaaaggagacagggaatatcacctacaattttactgagtgtcaattctttgaatatttttacgtttcattgtatttttctatgcattgagattattacatatgtacacatactatttttcaatatgaatacatactcttcatcatgttactggctgcattaattttctatcatagatattgtcagtaactattacttatttccttattgctgttcctagtttttcattattaaaaataacactgcaatagacatctttgtgcatgaaagattcttccacatactaagttatttctttaaggtagattctgagaagttaacatttacagggttcttaaaatatcactaagttgtttgccagagagatgatgccaatttatcttctcactgttttgtgagtaccagtctaatgagctccgatttttaaaaagatgtatataatggatgaaaaagcaacttaatgaaaagaaacatataaaggagagtttctgagctctagaattttaaaacgtaagtgagctgaaaaccatggaatacgcttaagaaaacaataaatgtgggcagcaggataagaataagcatgatgtcagcctgctgatggggttggatggggtaacatcagcaaatggcaaagaaaccaaaactgttcaacttctttctctctcccatgaaggagaatgattgtcagactgaaacaggtagtgcaaacattgacagaagggaattgaagcctgagatgggtgaattgattgtaaaagcaaactaagttctgaataaatgcaaggctcttggcccggacaaatgacatcccagggtcgagaactcagaggggtgaaagataagccactggcagtgatccttcagggttgtgggaaatggaagctgtactaaaagaataggaactgttggtaacctgattttaggaagagaagctggggaaaatgtgggtacgaaataaaacagctaacctgatggaacttccagataaaattcaggacagattttcaaacatacatgttacgagtggaagacattatcactttggagccagccatctgctcctcatcctctctcctcatcttctttaataaggttgctctaagtgttgtagttgctgtatttcaggatatcaggaaggcgtttcgttgaatttctgatgttgctttcatggatgagcttggaaaatgtccaaaaaccagagtatttagatggattgatcattgaacaactcttcccaaaaggagtcaataacttgatcagtatccgtccaaaaggaggtgactggtgtgtcaccagggtactcccatctcagccctatacgatctgcactttgtcagtaacctgtggaggtgacagatgcttagcaaagccacagatgacgtgaaattacagagtatagatgctagaaatcgatggaaatctggagaagactgcagcaggctgggatgatggttaaaaataataagataaaatgtaatatcaattaatatacattcttacagttgggttccaagtgctagctatatatgttcaggtagggtgagattataaaggtgattataacaataacagtacaaaagcaatagctaatgttttttaagtgattgctctatgccagatattggcctgtgtgtttcatatcatcatcatgtgtataattttactctacactagttttatgtcatctgaaaattgtataagtacattatctatgattcaatgatatttaattcacaggatgaaagttgtcctcatttttcagttgacaccagcaagacacagagaggttaagtaacttgtacaaggtcacacagctgggaaatagaggttccatgcttgtgctcagtgcctgcatgctgaactaccgtgaaactttttctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgtaaaaaaagaataataatcattgcagtgataagattcagtgtaaatgttcagtaattgctagctgttactatcaatagaagtatattgtccagagaaagaaaaatgctagtcctgttcctactgctgcgtttaggaattgaagccacatagatctctggaggaggcaggcaggttggtaagggtctacaaactgcagtggaggagttatctttggaccaattaaggacgtttcatctggaggcaaaatgactaagcaaggacgtgataactgtcctcactgtgttgagggttacaaaattggtgtgggtcattgaatcaagttatgagacaacatgggatgttgggaaaagtcaggggatcaggggcaggttgatcctgagtcagtctcttaacttccaggcttcagcttccatctttcacattttatgattctgtctccagcacgtagaacctagagcaaattcctgtttatacagaaagtttggataaggagtggttttgctgaatggctactgtagcagaaaagcttgaactgagtgttgctcaaatcaataaaatcacctgatgactaagccctgttttctattaaactgaaaagagaatgcaacagacttcactgggcttttgtgagaattacatgaggtaatatgtatgaaagcaccttatcaactctgaagtactaccccgatgcaagcagttatgttgattattgccatagctagattataacttttccaagaattagaatataatgaaacacacttaagcattaatctgtcttctgtgattcagaagatccttcaggaagttacaaaatctcagggtcatggccatgggcatggagtaattctgtagaaaaagatcctggctgtaaggtattctttggttttttggattcaaattaaataggagcatattgactacatgaaaccctgaagggaatagagatcacatactctaagcccgtcattgtacagatgaagtcactgagccacagagaagctgagtggcctgcccagaatcaaatgttaattcatggcagatctgggaataaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaagggcctgggtgtgtcactgaaggatatgacacaatatactggacctactcgggagaggggagaagtacagtagaatttttagtaactttcttaatcacagcagttcactttctctgtacaaaattcttttcaaatattctctgaaactaattggcattaaaaatgctgatcttagtaaatggccctcaagaggcacgctatgcgcacagggaatagtataatataggtgcagagtaatggtctctctccttctctcctttttttccttttcctaatgatcattaacatctatattctttgactttgttgaattaaagttgcaagagatggccgtaaataaagcaagttatgtatgtgcctccctcattctgcccatgcagcttctgttccatttgcagctgtgagccgtgtaagactctcaagaccaagcacccatgagtgcctgggagcaagtagcctgtgaagggaggactttattcctggatgcattaaaagcagagtcccacctacacctccctcctcttcccatttataaatctacttctccagggatctacagattttttggctatatttttagtctgttgataatttgagaaagtctccaaggatctaagtcttggatgggtaggagtcaattcactcagtcttttttgaatccctaatggatgttcaaaaccagtctcaattctggatctggatgggacatgcatgtcgaagtacagtgtgatggataagagcacagattctggaaccagattgcctgggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaatgggaactccctgtgtgaaggagaggaaggtccataataacaaatcgcagcgccattcttgttcaaaggtgacaccattgacagtaaggagttaggtttaaggtttttaccagttcaaaaactgagattttgctgagtaaccctcactgccactcccacctccctgtgattctagatacgtgttttcaaggtcattggagagagctggtacttcccatatccatggactgtttttaataggcatcactttctggccagtcaggagtcaaaaacaaaaacttttagtggctgtattttattctaaagatcataaagcagtaatgcaccataaattattatttgaaattctaatttgtttccatgtgaaaaaaaaattatcctaaaaacaccaagaaaaaagctcttaaatgctcatctctaatgatttccagtgcccagtagttctttttttggtgcactacaaaaaaggaattttggttttgaggggacttccacaggtttagaggaagccaactaccattcctcaaaactacactttgcaaaggagccacttggaagacaatcatgcccagaggccctggacattttccagggcatttgagccgtttgttccccacttcagcaggtaggaagagcagccccatatagcaaaccagattgttctttggcatgcctggtttaggatgaaaggtaattttttccaggatcaaactgagggacacttttataacacacttgtgaagtcttcgtagcaagtttaagtaacttatagtgagagacggaagctcctcttagcaacactgatgccattgctctgtttgagctattgattcacaccatgtgattttagagaatgaagatccattgaacatccagcttcttctgacccagcagttcttaaatttggtctcatgtctccttttgattcttaaaaattaatggagaccccaaagagcttttgcttatatgggttatagttatctgtagttaccatattattacataaattaaacctgggtatttacaaaatatttatgaatttagcaagtaaaatagccaactctatattaatgcaaacatattttaaaatatattttcccaaaccaaaaataatttgtgagaagagtagcattgttacacatttttgaaagtctcttaaaatctggcttaatggaagatggctggacgctcatctctgtttctgcattcaatctgttgcaagatcacatcatatgccttctagaacattccacctaagaaagaatgagagcgaaaaaggcaaataattaatattgttatgacaagatgttttacttcataggcaccctacaaaggtctcgggaaccctgatgggtcccaagatcacattttgagaaccactgttctaacttatcaaagatttctcacaacagcaaaataaaataaaactatagacttacagtcaggctcccagagagccaacctgagccaacctctcagcccctgctctgtacccccctcctgcccacttggttcctactcagagttcaagtaccaccccaccaggaagctctaatgtcagtgagtagaataaaaaggcagaagaccttttatccttactttgccctcttattgccagaggccagcctgatggtttcccagaggctgagtgaattgctcttcctggaagaagtttcagggaacatttcattatttggcagctctggaaggtcaagctcagctctggaacattctttcttcagaaggacgctgggctgcaatcagatcagctctgaatctgaggaccctccaaccacactgacacgtgtcatagttctgagcccctgtgggtgctgtgggcaccctggaacagcccctggaactgggcaaggaagggcaggtctctaagacctaccatcccttaaacacataaaagatctttttctcattttgcctctaaataaaaagttaatctgacagcacaccccagagtagggtttggtgtacaaactgctccctggactcctcttggaggctgcttctgggcttcgagaagcccccagtggggcggctcaaacaagggctggagaggggactcagagttgaacataagggctcttgagatgtggagactcattttgttaactattcagagaccttctccctttattccagctgtctaactgacaagacctttctctctttctttctgcctcatgctctctccaacaggcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgagagtctggactcttggcatatgcccaacttggaaagtctcttagttagtggttggtctttaacacccctcacccggcccaagaaatcccaacagtgagtcatcacaaggaagggatgacgatggaaggaagttgaaggaagattatgctagcatgagccagtttgagggaagaagaggaagtgtttacagaccaagggggagaattttaagtttaggagaggaacccagtttagtcctacgtacactggaacttaagggctctaactgtgccactaagaagaaaaagaaggctggccgtggtggctcactcctataatcccagcactttgggaggccaaggagggtgaattgcttgagcccaggagtttgagaccagcctgggcaatgtggcaaaacctcaactctacagaaattttaaaaattagctgagtgtggtggtgtacacctgtagtcccagctactcaagaggctgaggtgggaggattgcttgagccaaagaggtggaggctgcagtgagctgagattgcaccactgcactccagcccaggtgacagagcgagaacctgtctcagaaaaagaaaaaaatgccattttggccttttgactctctaaaagagatagctgagagtgaatgcaggctgtgaactgctcaaccgaaaacaaagagaggaaggagaaggacgtagaagggctagaaaagaaaatagaactgggggaactgcagataaagactgggaaatgggagatcctagtagccaaggccagtttagaaaggcttcaagtggtttcccttagaagtaggactcgtttgaggtaatgcatcttgtagcctgtagaaatcctaaaaaatacaagcagaggtctcctcgggctcatctgactcagaaagcttgtctaattaagggctcctgataatgcattagaagatttccattcagtaacaagcatctctacctgcagagtgtattgctcatgtggataaggcttcaaagatttgtctcagtttcatttcctaaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttcttttgaatttattacaaaatacttcccttttctattccagtggaaactcagagatattatactcaaagaggcaacgttatatatctggaggaaaaatccctacctctttgtgttccaatgaaaccattcatgtaaagcaagcaaaggaaaatacagtggtgggttttgacttgatttgacttggaccttgggcaagctttcctcccaagtctctataaatttccccttcatcctatctcaggtgcacttttttatagctggtttattttcctccacagtgacctcttagcattatttgtgaaactgggttctctctgctcagagctatgaacaaagatacgtgaaaatctgtccgcagttccttgccactttgtcgagtctttgtcaggtgggccatgtggaagatggtgctgctctcaaggaagttactgtccagttagaggcaggattgcgttgatctaaaaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctatatagatcagttaggaggtggcaatagaaattcattccatgagtattcaccaagcaactctatgccagaggtacacaggtacaggctaagggagttcagagattagaggggccatttctagctggcttgtcgaacaaacctcatagacaaggtaatggagcctgactttgaaaactttgaaaggcaaacaagaaggagatgaggaagcatgttaagaaggagatgtaggccgggcgcggtggctcacgcctgtaatcccagcactttgggaggccgaggcgggcggatcacgaggtcaggagatcgagaccatcccggctaaaacggtgaaaccccgtctctcctaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaagaagaaggagatgtaggctggtgtacatggaagaggaattcagagacaagactgcacgtgctagacactccctttgaaacatggtcgaacatcactcaccatgcctctccggcttgtctgattgcctcctcacatttcaaactggtggactgtctcctggaaggcttctcttgactcccatccctacttccctaattccattccactttcctttctcccatcttgttctacctccatctaggctaggtgctgtttctcctttatcttagagcattctttccctctgtcatggcccttgacacagatacacacacacacacacacacacacacacacacagtgttatacattgtttgctgattgtttgctactccggatccctcccctagagtggaaagttcaatgtgggcagtgattgtgttctattaagtcgccaagtctccagtacctaacaccagggcatggcttccaggtggcactcaacaaatgtaggttgaatgatgacccggtttgagagtacccaggttaagaagtttgggttttattttacaggtaattggaaccactggaaagttttgatcagggaaatatgattggagctctctttttgcaacagacattttccaccagtgcgtagggtagattcattggcttacttaaagcaggaaagctagttagagtgtccttgctgtgatcctaatgggaggcagtgaagcccagactggatcagtgagatcaaaataatactcaggcacaaagtggctagctaagatggggagctgacttggaagtagtggttagagttcatttttaaagcaagcaatgccaggacattcaagaaaacttgtcctgatctgcagttggacatctaaaacaagaggcaggccagggctgggaataatagatgtgagcatcatacatcgtctccattatgtagaattttatgagctggggataaagataaatttatacggaaggtaatttaattaaggcacccactagaaagccatggacagaatttcaaggcgatgcctgccagcagggcctgtaggaaaacttaccacagaacacaggagtattgcgaatgggtttataagacaactaagttggagttgagaagacccatctgatgaaggggtcactcagcaagagggggaaggccacaggcatcctccttaggcaggggcaagatctagattgaaaatcctttttattttccagatgtaacatttgccactgtttcttctgacatgggctttctcctttagcagtttggtgtagtgaaagtcctcaggcctggcttctttctacacctggcccttcacaaatcacgtcacttcacttggccttattttcctcatccacaaaatgcagttctcaccacatggatcctaagctcccttccattcttaacagttcagcccaacttcaacactgaaacagtgttaagttgctagcaaacaatgtagctttctatgctctctatatatggaaacaacattctttaacacaactcctctccaatgtagagaggagagcactggactcaatgagttataattacctggaatacgattataccttaagtcaaatacagtagactccctgaatgccatattctttgaccagcttaacaaatttatcgcatctacttccaggacaagaatcctccattttcaacccctaggataaagcagggaacatttgcagtgtgctttaaataattatatggtctctaaccagaagatttcaaggttggagacaaatggaatattttctttggaatagtctcccagttggaggatataacagatgacaagtttataacatttgtaaagttaaagaataaatggaagggatcccaattttataaaacgtcacctggacagaataattttacaaagaccttgggctactagatagttatcacattaactggttctgaagtgatttaaattcagagaggtatttgagtacttgactactttgagactctgagaaaacacattgacaggagggaacagacaggttggcatttatattaacccttacttagggttatccattgcatgacattcaggtggaatggatttaggtacccattattttctccgaacaaggaaacccacaagttattatcaatttaattcatgttacactcacttgctatcaatgctaaaaaagggaaagaaacatatgttcagagttccttcaattcagcaaaactgtattggggatttgctaaatatattgaggattttagtagactaaaatctgcagtcttttcatatactagagtgtgattttgcaaattgtttcttccctttccaacccaccagaacctttgtctttggaaatatgctttgcttatatttttcaaatatagtaaaattttctttcaaagttaaactgaaaatactggtctttacatagtatttcttgaatcaaaattggcctattaatttctattaagcaatggtaggtttgccagattgaagggctgtgtcaactggctattttagaattaagtcagagcatccaaggatataggtcacagaagggaaattgtagccatgaaatgtgggagttgtagcaggcatgacccttgtctgaagacaccagagttggctctttctttactgtgtctttgagcaagccaaaaaaaaaaaaaaagtgtatcacacatcagagaaatgcttcgataggtcacttacgtgaaagtcattttatttcttttcttttttttttttagatggattctcgctctgtcgccaggctggagtgcagtgccgtgatctcggctcactgcaacctccgcctccagggttcaagcaattctcctgcctcagcctcctgagtagctgggactacaggcgtgcgccacaacacccagctaatttttgtattttagtagagatgaggtttcaccgtgttggccaggatgatctcaatctcttgacctcatgatctacccactttggcctcccaaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaatatttgttgctaagtaaaagactaatttatttttgtggtcacagaaggcactccagattaaattaaaaggttaattcaattggcctgcaaaaatgcactgaatggaatgcttagaaactaggaccaggctgggtgcagtggctcacacctgtaatcccagcacttaaggaggccaaggcgggcagatcacggggtcaggagatcaagaccatcctggctaatatggtgaaacctcatctctaccaaaaatgcaaaaaatcagccgggcgtggtggcacgcacctgtattcccagctactcaggaggctgaggcaggagaatcgcttgaacccaggaggcggaggttgcagtgagccgagatcacgccattgctctccagcctgggcaacagagtgagactccgtctcaaaaaaaaaaaaaagaaaaaagaaactaggaccaagcagagttagaaaaccaagcagtcccattacaggaatgggcatgttatgcactggtgttttcactgttgaatttattatgtaacttaagggaccgaagcttagggcttcatcctgaacccatcaaaggcagaaagggcccaacagagagaacattctgacatatctaaaaagtacctctcccacaccaggcatactcttactttaaaaaaaaaaaaatggccagagggaatctgaagcctctgaataaaaatcaaagagaagagagagctgtttgcaaattaaagaatgtgttacttagataatctacgtgtaaggatatgtacatagcaaatcatcacctgaaaaatgcagattttaacaatgttagggttctactttaaacctgctaaacttgagaagttaaaagttgcaaaaccccctgggagaggctctaggtagcattgcagatgatgcgaaacattgattccagccttctgagaacaagtagcgtataataagaacgtttaaactaatcatacactttcactgataattctattcctaagcaaatagccgaaggaaaccatccaagagtgggcaaaaaaaaaaagatgcccttaacaattctatttatagtagttaaaaactggaaattccccaaccacccccactgtgggactagctaaacaaacttggggagagtaaatatcatgggatacacggtagcctcacagccattcattcactcactcactgattattttttcagtagattttgcagggctctgcaggtcatgttcaggattttacatgtttgtttgaagacaagtagaagccatttgttttttgttgtttgtttgtttttgtttgttttgttttgttttgagatggagtctcgctctgtcgcccaggctggagtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatgatgtcaactggggaaaaaaattccatccatatgaatgtgactttgtaaaacttacgcatgtgctttaaatacaaaagtactgaaacaaagaacattttttgccagattttgtgagacatgtctgttcacgcttatgacaattgcaagagacaccatccattgagcgtttatgatggcagacgtggggctggtgctctgcacgtatcatctcatttaatccttataacagccctgccaagtctgtggcatagttctcattttacacacaaaaatattgaactaagccctgaactatggctcggagaagaaaaatagcttccctaagggcatacagctgacaaagagaggaacaagattcaaacttgggactcccttgctccagagcccaaattctttcctctaaaattaagtaacttaaataaatttaacccccctcaacagcatcttgcatgttcttggtcctcagacattagtaagattgatcagccaagtcacagcagtattgttcactcgctctctcctgtccatttggaacacattacaatacaataatggaatttaggattctcaaagaacgtgcctggcttttcatgtaaagatcaccaatgcaaaactgtgttttgtttctgtgtgtgcgtgtgtgtgcgcacgcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatcccagagactgttttggcgttgtttgtttgtttgtttgtttgaaacaaggtctcactctcatgcaggctggagtgcagtgatgtgatcacagctcactgcagcctcgacctcctgggctcaagcaatcctcccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggaggctgaagcaagcccatgcagaagcctgggaggtgtgcggcagaccacgtgtcagacccccagaggcttagcccaccaggtcaggatgagacgtccagagaacccaagactaggagagtggcctcagttaaccttctttaccctttctggaaggggaacgtaaagctggccgtgacccagatattcctctattctccatgtgagacctccttagagatctacacacctgtcccaagccactataataatatcaggaatagtaatgatgggagtgtttgtggtggtggtggtagtggtggtggtagtaaaatcaatgactagtgtttactgagcttttcctgtttgcctcacgccatgatgagcttgttacatagaccatcttattgaatcgttacaacgatctcacaaggtagatgccatcaacactgccattttatagatgaggaaactgaggccaagtgacattaaagggcatgcccgaggaggcaccagtctgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttcctggcctccccttccaaaatggatacactaattactggacctttttttttttagtaatagtaatcatcaggaacacatttttcaatgttttcatttttctattccgcatactaccaaaaaaaccagataaaacccagcaagtgtgaggccctgtaaattagcaaaagttcaggaagtcattacacgaaaccaaaagaaacaaagtgttgattaggggcttatttttgtatgagattaaaatatgaatcattaaaataggactgtatttcaggcttcttatccccgcctcatcagagacatcaccatgactactaggtttggattcaatgaattccgaagccgttctcagctctcaaatgcagtcatgtgtgccatggttctgccttatacatagcagtttcaaaagtctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttccctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaacatcctcacaaaaaataagagcaataaattgggatagtttaaattccctgccattgttcggcagctactgaagcagttcagtaatgtgggaaaatgttcaaaacctaatgtggagggaaaagaggatactcaactattaaaagcccgcttctaactatagaactatagatagtattaacagggcttctgtatcttagtgatgatgggattctaggtcatgttttgttttctttctgattttctgcctttttaaaacatttttggggccgtgcacggtagcttacacctgtaatcccagcactttgggaggcctaggcgagtggatcacttgagctcaggagtttgagaccaacctgaacagcatggtgaaaccctgtctctactgaaaatacaaaaatcagctgggtgtgttggttcgcacctgtagtcccagctacttggagggctgaggtgggaggatcacttgagcctgggaggtggaggttgtagtgagccgagatcgtgcctctgcacttcagcactggcaacggagcgcaaccctgtctcagaaaaaaagtatacgattttcataatcaaaaaagtttgatttacaacttcacatcgctctgaccttttgagtttcaagtgctgcattctgtgccccatgagcttggtgagggtaggaggtggcaggtgcgctccaattgtatctttggcaccgtgccaggcacttagctgctgctccgtagatcgttgttggaaaaacatctttccatttctcgatttccctttcctttttctttccaggtgatgtgctctatgaactccttcagcatattctgaagcagaggaaacctcggattcttttttcaccattcttccaccctggaaactctatacacacacagccggaggtcatactgcatcagaaccatgaagaaggtactggaagaggtttctcttttcttgcctgaggtttagacaaatccaggaagtttaattgttaacttgataagctggtcttcttcgtgtaagttcacttttcattcagtagacaattattgagtgcttactatgtacaaaatacactcttggttccctgaagctcacgatcaaagcgaagcagtgagatggatgtacacagaagcacagaagcgtaaccatatagtaggcaccgtaaaggtgtggtggaagggtccatgacagccaggtgcaggaagcagggtcttctcataaaggaagcaactctggagtatgccttagagcagtgctccccaccctttttggcaccagggaccagttttgtggaagacagtttttccaccaacagtggaggtgagggatggtttgggatgattcaagtgcattacatttattctgcacttcatttctattattacattatcatacataatgaaataattatacaatccaccataatgtcgaatcagtgggagccctgagcttgttttcctgcaactagacgttcccatctgggggtgatgggagacagtgacagatcatcagccattagattcccgtaaggagtgtgcaactagatcccgcgcatgcacagttcatgatagcgtttgtgcttctatgagaatctaatgccgctgctgatctgacaggacgtgggactcaggcggtaatacgagcagtggggagcagctctagatacagatgaagcttcactcacttgcccccaccgctcacctcctgctgtgcagcccagttcctaacaggccatggactggtaccagtcagtgacctggaggttggggaccccgccttagaaatccagcaggattctgataagcaaggatgaagtgaagaacattccaggcaaagaaaatgacgtaagggtggggtaaggctttgaaatagagagcaattagatgacttggattataaagcttatcttctcccactcttttattacagaaaatttcaaacatactccaaatagaataaaataaataaacccttctgagccatcacccttgccttcacaatgatcagcattttgtcattgcagagctagtccaaggagcttagcttggaaccagagtgtggagaactttgatttctggaatatggaggaaagaaatgggaagtcattggagagttttttagcaaggggtaataaaagttggaagaaggaaagaaaaaaaaacccaaatctatgaactcagtgttgggccagggctttctgcatagggcaccaaaggaggctggttagagttcactcagtggcggtgtttatttcaagtgtcccagttgttcctcttaatcattggtagaaagcaaaagaccagaatttaatttaggccctggacctagttccagaataggtgttggggcacagaaatagagtataaaaaccttacttgaggccaggcgcggtggctcacgcctgtaatcccagcactttgagaggccgaggcgggcggatcacgaggtcaggagatcaagaccgtcctggctaacatggtgaaaccccgtctctactaaaaatacaaaaaaaaaaaaaaaaattagccgggcatggtggcaggcgcctgtagtcccagctacttgggaggctgaggcaagataatggagtgaacccgggaggtggagattgcagtgagctgagattgcgccactgcactccagcctgggcgacagagcgagactctgtctcaaaaacaccaaaccaaagcgaaaggaaaccttacttgagcaccattgcattaaacagttgaacagcttgagcactcagtgatggatcgtgcctctgagggtcatgatcctcctgctcggattggtcagaccacagacgtccaaacgtgcatcagtttcttcatgtgtacttttccttaggtgcagattactagggacctcaaaccctggtcccttggggcatttccttaaaatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggtggccctctccctatcctcctgcctttcagctatatggtgcccttgatgacaaagagaacaagtagagaggtgcatggatcagtacaagtttcctgcctccagctacttcctctctctctcccttcttctccactgaaaagaaaaaaatccagctcaacataaattgtttccagaatcaatactgttccatttaattatgaaggataacagatgattgatgtgggcatatgttaacatacagaaagatctggttctgaaaaaaaaatctgtcaagtgaaattatacatatcaaatattacttccccagtgatttattttacataactgggaatacagttccatataaaagtatgttaacccaagatgacacatgttgctgccaacttggcataggtaagtaggtaggtgggtaggtaagtaggtggataggtggataggaatgacagaatggaaagagaacaaggcccaactcagctgttaagcagcctggcacaatgaagcatgcacggtcaagtgcaaacagaaggcatcattcaaccgccttgtgatttcacctcgtcgtggccacaaacttaaccagttcagacattcataatttcacaatgggcatttatatcacagtacaaatgtgtcttgctcaatctagcaccagttccccacatgtatcctctatgactttcttacattgaaacttacattgaaatcatgccttcgttagtagccacgtggcagtgctagaagctaggaagttggtgttagctcagaggttcacctccatgccctgacagtagacgaggatgatcatcatgctaattcaaactctctatatgtgaacatttgttacctctataatgtactccattctgaaatcacatcatggcttgagcaaagcagtcctcagattacacttacctctagaaaaaccagcattttcactctttttccttacttattagttatgggaagggagggtgattttatataattaggttaaccttataatttttcacccataccaacacacttatgacagtgacacagggctccagcaataagtaagccaggactacatatcaaatattcaggcaaaaccagaaccagaaccatcctcgacaaacaaactggggtgagtgtgtgtgagtatgtatgtatattttaaaggatgagatctggaaaccgggaaaccaggtcctaacccttcattctgccagaacagatcataagggctaagtttctcattcctctggctctgtctccccagttataagaagggggttaggctaaatggtttctgcagtctcttacagctctcaaatccccacattacgtccaaggaacctgagtcttcctgggtgatatgaagataagacatattcccttccctcagggtcttgagcatctaaaatctagaaaatcatagcagtgtcctgcctggtgttgctcagaagcgggagaaaatctcttctttcctcatttgtctcaccttattcagaacttcagataatgttgcccctctgagagtggcagcaagagtagcgtcattcacttatttcatcataaaaagctcagtttaaggacattctttttccttgactgttgtgactcattttatctttgtaatatgaattagaatgcaggtaggtagttatgtagaaaggaggtaaaataaacaatgatattacttccttcacaaaaaccaggaggcaaagcatctttagaaatatcaaagcagtaaatgactataaaataaatttattttgtcacgtgcagttgtgatgataacttcttttcacaccttaggttcttttattttgggttttatccccttaaatatatatatatatttttttttaattgtcatttgtcctctagtgttagaactactggaatattggccccccaaaaactcaacggaaacataaaataagcctcccttctgggctaaagtctctgaatgagaccagctccacagaatcaccccatgggactggatatgcagtctgtagggagaaggagcaagatccggatttctcaaacgttctcatcccatcacccccttggagcttgataatttcagctctttagttgcatcctgtcctctgccccatcaaagagattatggggcagtgattcttaatcactttaatttgcagatattcacacatgcagggctgagattgtttctgtagcactggatgcagttttaaggtggcagttctgctctgggacagctctttatcacaaggtaaacatggaaatcgcaagtgatgaggagaactttcaagcatcgaagtgcaattgatctcaatttttcttacaactagcacatgggaatggctcaataattgagagaagtcatttctttgtgaaagatggagagggtggcatgtgttctgcgatggcccacagaagttttatttatatgattgctttattgaggggaatcgtacccctcctgccccaccaccaaacccaagtgcccaaagactgctttggcagaaggaagttgtatacaattttaatgagataattaaagaagatgaggtatatgaatctggttttttttttttttttttttttttttttttttttttttttgagaaggagtcttgctctgtcgcccaggctggagtgcagtggtgcgatctcggttcactgcaagctccacctcctgggttcactccattctcctgcctcagcctcccaagtagcagggactacaggcatccgccaccatgcccggctaattttttgtatttttagtagagacagggtttcgccgtgttagccaggatggtctcgatctcctgacctcgtgatccgcccgcctcggcctcccaaagtgctgggattacaagcatgagccaccacacccggcctgaatctgcttcttaataacaaaataatagctaacatttattgggtccttgttgtgtgccggccctgttctaagctcttatatctttgaatcatttaatcctcaccacaaccctataaagaaggtgatattattacctccactttatagatgaagaaataaagattaagagcaataaagtaacatgccccaaaatcaagtagcaacgctgagatttaaacccaggtggggttgatgccagtgcctgcattcattccactgcgcagaatgaggagaccaaaatacattttcataaatatttgtagtgtaggcgccctgaaaatagagcacatgattgaaagacgagtagcagtagtggagatgagaacgccaaagcagttttcaggtcagctgactggggctacagtgtgtggcaggtcctgcttacattactgccaaatttgtactaaacaatgtcaaagatgacttctgggactccaaagtatgtctagttcataatattaaaaactcatgctgagttggaccgaattcacccttctagatcattaactcccttgggatgggccgtcttagcatcacgaaaatctcccagcctgtgagaactgtgggttctgagccaggcaccggcttctgagagcagacacactggctgtcacctaccccctgaggagccagcccctcagtgcaggtcacgccttgaaagctggcccctctctacagcggcttagtaggtaacaggtagacgcattctttagctgctcaagtcacatcctgtcactggttgtaaacccactcgattctctagtcttgctggaatcgtgttgatgactgcagggtcaaggaggctgtgggctggggtttgacatctttgttacacatattaaccacggaatacatgacagagccagagagcatgccggcacgtatatgcgtgcactctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctcaaaaaaaaaaacaaaacaaaagaagaaagaaatgagttaatacggaaaatgcccttagaatagccaagcattcggtaaatgttattcattatcatgattcaatatttctggctgttatttggttgtttccccccctctgtttgtgtaaatttttaattgggataaaatacacaacatttacaattttaaccatttttaggtgtacttcagtagtggtaagtctattcacaatgttgtgcagttggtttttccttccacttttcttaaccattctcaatatcgcaactacatccactttgtgcaaacatcaggtttgtgcaccttatacgtagggaagggccattgcctccctcactgttatccaagaacacctttgaggattcatctgcactatgatttctgtgggaaaatacatttaaagtgccagtcttcattactctcagaacacggcctgtttggaagtaagcactgcttgcattttatgtccccttgcagtatctggcgagcgctgggtcctccatgacccctttggaacctttgtattaatcttctggctgtctcctttaagaactacaagattaacctttttgcagccctttctgttctgggattcttgaatctggcagcaggtaacgacaggtcccatcagaaacaggtcaagatcttgacttcctgccctccctgggagcagggcccacgagcaccacttaacacctttttcccctgacccagcctcattccagccttctgcaagtcctgctttcctctccaggacctttgttcctgctttgcttcctatatttcagggcctagggcagcatgaccttttaccttctgacccttgcccctgctgcagcatgtgttttgtgacggagtgtagggactggattgtgcagagaccctctttgcatctgtctgggccctcggcctattacaggagggacccctcacccttcctgcctgcaccagggtcctccaactggaggctgcttttagccctagggctagcgtgctctcttaagccagaagttttaggggcaagagatccctaatatgcatgaatgactctcacaagacaggcaggaagtctccaagagacttcctttacccctagggaaatgccatctgatctttgagataaggggctgggagcagtttgatttcatctccagagaaggaagccctcagttaaggggtcatcttgctcttttccccactccagggcctctctgccttatctctgtgccacctgtgaccccaggccttatacatgattgagaggattacccaaacagacctaattgacttattggaaatccaatcctttgattttttaattcacttcttttgtgctgctttatggagacaaaggagactcccctatactgcctgtgaagagcaagacagtctgcagccccgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattagttagctagggccgctgtaacaaagtaccccaaacggggtggcttaaacaacagatatttattatctcacttttctgggggctagaagtccaaggtcaacgtgtgccagagttggttccttctgagagagctgtgaggtaggatctgttccatgactctcttctcgtttctggtggtttgctggcaagctttggcattccttgccttggaggtctctgccttcatcttcacctgcattcttcccctgtgtatgtctggaagtccagagtatactttttataaagacaccagtcatattggatgtttaaaatgacctcatcctaactaattacatctgcaaggaccgtctttccaaataagatcacatcctgagggtactaggggttaggacttcaacttatgaattttgggggagagatagtcaacccataatgggcataagagaccgggagtggtatatgaaatatagtttgaattccacctcaagaccttgagcttatgacttctgtctagctctgtgtatcattcatacttcccactaatttttaacaaaatgactgggagagggagaaagtgaaacccagtggactgaggcttgagtgagcattacctcctgggcctgttgatttgcgtctccctggtgaccttcttctctgaccagcatccgtgggcttagggaaagcacggtggtggaaatgtgatcctggtgtgtgagatgcaaacttgatcttagcctttgctctccctggaaacttatcggtcaaaactttcactaaaggcagttttttgtctgtttgtttaggtttactggttatttattatttatagcatggttaaattgggtcaaatttttatgaattgtaagtagagaaacttttctaataagaggaaaggataagaaatcagacctttttgtaaagaaaattaccccacttaaagtcctggtttattttaggccgtttggcagtgagaagaagggattatttgtgtctgacagaggtctacaaggaaaaaggtttgggatcagaaaacacttccaaccagaatgacggttccctgccagtccttggtctttcttcctcccttccttctgtgcccacatggactaattatgtctggctttccctccctcttccttgtatatttcccttccatatcaagaccttcagaatgagggcaatgtggataatttcccagttttccagctgggcagctcaccaagaacaaacccagacatcaaggccagaccaaaaaaatcttcttgttttagacagaagactcctacatctgggggatttaatgcacccactgtccgctcagtgcatttcctgtgtccggagcttctctgcctgccggctctggtctcgtaagtttccatgccctgctgccaacttataataacagaggcggcaggcagcaggctgagaatgtcatagcctactccatacatgggcactgctttgcagactgaaacaaagcttgcagggtctcattgcaggcctctcagccttgacagtggttgtgcccagaccaccaggagcctggaattaaataccctcggatccagttctctactgttaatgttatcagcttcatcaagtacttcctctttgagtgatatctgtggagaaataaataaatcaagctcctccaagtcctgttcctgcctggatcctgagtccaaagtaaaatctgagttggattatccaaagcactatcaccctcctgcattgttcccaaggtctgggcaggaacggagagtgaaatctctccaggacattacatcagttcctcctttacccttggcatgaaagttcttcctctcctggtcctcccagacttcctaaggcctgccctgagtgcacacccacacactaagccttgaagcccaggacatcaaagaaagcctgcaggtaaccagattactgaccaacgcctgtgaccgttttgaaatttataagatgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccaggcatggtggcgggcacctgtagtcccagctactcaggaggctgaggcaggagaatggcgtgaacccgggaggtggagcttgcagtgagcagagatcacgccactgcactccagcctgggtgaaagagcgagactccgtctcaaaaaaaaaaaaaaaaaaatagtgtcaacataggtctcaaaaaaagactataaaatcataatagaaccatcatatcacttgaaaactagtagttcctcggtatcatcaaataatctgctagtgttcactttttgccaaccatctcataaatgttttttacagtttggatcagaatccaaacaacatctatacattgcagatggttaacgtatctcttaagtttttttcaacctataggttcccatctgcaaccttcttgtgtgtgtgtttgagcagtccctctcttcaggtttttttaaagaagtcagccataattagtatattcgtatatataatatattatatatattagcgtaggcttatatatactatgtaagtatatacttatatagtattagtatatactatatatcatatatactataatcatatatagtatatatggtgtgtgtgtatatatatactatatatcatactatgcatatatagtatattagtataatctccccctgtacatagtttctttttttcctctggttgctttcaagattttctctttatttttggttttcagcagtttgactatggtgtacctgggtgtggtttttattttacatatcttacttgagattcttggaccttcgaatttactgttgttgataatgttgttaccaaatttgaggacaatctagccattattttttaatttattctactctgtttttttctatattctccttcttggacaccaattacatgtgtgttagaccacgtgatattgttccacaggtcactgaggatttgttttgtttggatttcatttttactgatctgtcttcaaattttctaaccctttcttctctcatctccgttctgctattaagtccatctagtccggtctttcatttcagatattatacttttcagttatagaatctttattttgcctttttttttaattccatttcccttttggcagcctgtatgtgtcatcatttattacaaccatgattttcttttagggcttgaacttatttataatagctgctgtaaagtttttctgtttgtttgtgttaactccaacatctgcattatctcaggttctgtttcttttgatggcctttcctccttattatgagtcacatgtttgtatttcttctcatatctagaaaattgtgactggatgctgagcacattgagacactggattgtgttctattccactgaagagtattgacttttgttctaggaggcaatcaaattactggccagttactttgaatctgtagaggcatggtcttacgtttcattaggtccaatctgtttctattttgccttttgcccttagcagatccccttgtcctagggtttttactcctacattgtggccattctggggtaacaaacagcctgaagtgtttacagagcctttgaacttgatgagactcaaactctgaactctgtctccactgcagtagccagtagctgaggtttccgcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaaggagatgatcttttaatattgtgaacaatatttttgttcagtgatcatatgatagatgagatctagtagaactttcaaaaaagaaaaaagtccgcattttcttcttaaccctgtgtaaaacttaaaaccactatgtctgtctctgtttactgaccctatcaaattacggaattcactttatgtgttcttcatatatgtatattatcttaatggacaaaggtgatatgtttgacttgctttacttagaactgtggacaattctttgaccagaacaaggacagcaagcatgcacatccttttggtgagactgccctgggaacagatgtggccagagagagttcattgagttgggtgtggagccgtgtagaaatccccatttttatgggcagatttctgtccttctgcaccttagcagggacttctggagccaggtgtgtgccggtccattccccgacccagccctcagagctacttctcttgctgagctgtgtacacttctgatgttatcctcgctcacatgtcaccagcttgcaactttgagtgggatgagttagaggtgtccatccatcctgcttcttccttacttctgcctgtctctgagcactcaggagcaaagtgctcccaaaagttctttcaagttcagtaagattgtcattctgtaaattggggccactgtgcatgcttagagcaggttttggtgtgactttgtgtcatagtttctatattgcagtgacagatgttgtcatgagtacacaggttctagaatctgactggagtctggttctataatctcctaactggctgtgtgaccttgggtaagttatttaacttctttacgcctcagttttatcatctgtaaaataggggtactagtggtatctcttggttaggagtgtcatgagtgtcataaggttgggggtttttttcttttttcttctttttttttttttttttgagacaaagttttgctctgtcacccaggctggagtgcaatggtgtgatcttggctcgctgcaacctccacctcctgggttcaagcgattctcatgtctcagcctcccgagtaactgggattacaggcgggagccaccgcacccagccaggagtgctataagttttaaacagtgaaatccagcatctaagatatagttattactaataattattactaatattattaacattatcactaatactaataactcctagagttagagaatatgaaaattttagttgtgaaaatgtaagtcaatgaaagcatctagagagaaacctgtaagaacccttccacctctgaaagcgacgtagaagagttaaatgatggccaaaagatggggcatggaagtttggcttccttgtgcctacaggccacaggtaggtcattaacggaatgcttgtagacatccttaggttgtctggcaatagaaaaatagtttcaatatgcacaccttaaggccaggcgcggtggctcacgcctgtaatcccagcactttgggaggctgaggcaggcagagcacgaggtcaggagacccagaccatcctggctaacacggtgaaaccccatctctactaaaaataaaaaaaattagccgagcatggtggtgggcgcctgtagtcccagctactcgggaggctgaggccggagaatggcatgaacccgggaggcagagcttgcagtgagccgagatcgtgccactgcactccagcctgggcaacagagtgagactccatctcaaacagaaaaaaaaaaaaaatatgcacccttcaaattgttaagcagtgaaaaagacactgcattctggggagaaaggtcctttacacatacctacacgctcctccatttaccgcctgtagagccgcagggagtttcctgtcctgccaactcactggggtctgtgattgtctttccctctgctccacagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcaggtgagtgagttcccctctcgccgctccagcatcatggggacctgacaaagtcccactctcccctgtgatctttgcagccagcctcgcaccattcccaattaggcgccctccaaggctctctgagggcaattggaggcttctgcttggatgaggctaaatccctaatggcttggttaatgagccgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtctcagattcaggcctgtaattccatcctgtgagcggtaacgccatgcagccttcaccttaggagcgggtaggagaggaaaacaggattatggtattggaggcaggtgttgctgggccatttggacagaggaaaccactcccagattctctttcatttattataagaagcccaaatttgcttacttaagggaagaaaccagtggaaaccagtgggaaaaatatctacacattgtctgtttcctaggatgctcataatttacatgaactcattcttcagaagcttaatcctctaaccatgtgacaaggttagctcttttcgtagagcatttctccattagatatttgttgagcacctgctgtgtacaaataaatgcattaggagtagggatacagagctagtttaacatgcaatatctttttccccaaggaatttagaatatagtgggagagacaaaggtgaaaaccactaagatataaggcagaatgaagtcagccccatttcccattcattttatgtaccagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggtgagagctctagctgaccatcaaggtgctgccatgctgatggcagtggaagaacaggctcctacaagcctactttacttctgccttgaggtactgtcccttttttttttttttttttccacactctgttgcccaggctggagtgcagtgacggaatctcggctcactgcaagctccgcctcccgggttcacgtcattctcctgcctcagcctcctgagtagctgcgactacaggcgcccgccaccatgcccggctaatttttttcatatttttagtagagacggggtttcaccatgttagccaggatggtcttgatctcctgacctcgcgatccgcctgcgtcggcctcctaaagtgctaggattacaggcgtgagccaccgcgcctggccggtactgtcccttttttatttaaatcatgtatttctagatttttctctggccccaagtgcaccaccagtgttgtctcagtttcactgttataaatcatttacatcagggatgttgaatccagaaaataaaatggcaaacaaaaatgacttatatgttttaaaaactatgaaaaaggaaatgatatatgtttgggattccattcaaaacgatcctgcagagttagggggtgagatgtgggtggggcctacataaaacaaggctagccatcaccagctagtggctatatgtctgggtgatagatgcatgggggttaatattattgatctctctgcttttacctgtacattagattgttttaatcagaaaatgaaaaaataaaactggggaaaaaaagaatagtagataaagaagcaaagagcttgggcaaaacatgtgaatttccccaaataattggagaaggaggatgaggtcagtgtattgctgtgaattctataaatgacccatctcgtgctttccaggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaaggtcagataggggccccatgaccgaggtgtgcaggacaacccttgctgcccgtggctgctgtccatagtgctgccctcgtgggcctggcttgcttcccaagatctctcctgtctacctcccaggtgacactgccttcaccacttcttgggaatctaccataagcccatgaatcaagaaagacacatggtttagacttgaggagttatttttcccttatttagtaggtttgtaaatttcaaaatattagtctcttaaaattatattactttttttttttttttttttttgagacagagtctctgtcacccaggctggagttcagtgatgcaatctcggctcattgcaacctctgcgtcctaggttcaagtgattctcgtgcctcagcctcctgagtagcagggattacaggcacacgccaccatgcctggcgaatttttttgtatttttagtaaagacggggtttcaccgtgttggccaggctggtcttgaactcctgacctcaagtgatctgcctgccttggcctcctaaattgctgggattacaggcatgaaccactgcacccagcctatactactatttttttcatctcattccccaatatcagtgtttgatgatggatgcggcctcatcggttaggaagcttggtggaatactgcacccaccaaatgatgagcctgggtgtctatgggtgcccgctctctcaagggcacacagaaataggcaatatgtgcttttcttgatggctctaggaagtcaagaatattcatgtaaaataaccctggggcctagatcttttgggggaatgcgttaactccttcagtataacacaatgtcctaaaactaattaccagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcaggatttcgagaccagcctggccaacatggtgaaaccccatctctatcaaaaaatacaaaaattcgtcgggcatggtggtgcacacctgtagtcccagctaccgaggaggctgaggtgggagaatcgcttgaacctggaaggtggaggttgtaatgagccaagattatgccactgcactccagcctgggcaacagagtgatactctgtctcaaaaaaaaaaaaaatgtgtgtgtatatatatatgtgtgtatatatatacacacacatatatgtatatatatatgcgtatgtatatatacacacacacgtgtatgtgcgtgtgtacacacatatgtgtatgtgcgtgtgtacacacatatatgtgtatgtgcgtgtgtacacacatatatgtgtatgtgcgtgtgtacacatatatgtgtgtatacacatatatgtgtatgtgcgtgtgtacacacatatgtgtatgtgtgtgtgtatatacacatatgtgtgtatatgtatatatgtgtgtatatatgtatatgtgtgtatatatgtatatatgtatatgtgtatatatatgtgtatatatatatgaaatttttcataaattcttttcattatctattatcactgaaattccatcataccattaagatacatgcagaattgttctcactcataggtgggaattgaacaatgagaacacatggacacaggaaggggaacatcacacaccgggtcctgttatggggtcgggggaggggggagggatagcattaggagatatacctaatgtaaatgacgagttaatgggtgcagcacaccaacatggcacatgtatacatatgtaacaaacctgcacattgtgcacatgtaccctaaaacttaaagtataattaaaaaaaaaagatacatgcaaatttatgtctgttaggtatttaccatatggaaaaactaaaataatcaagaaaggaaattcagtaggtggttgacagtttaaatacaaatcacaaatgacatctttttaaatataacaagtagcttatttttaaaggtgtcacttactttgcaaaggataaggagaactgttattaagaatttaccaggttggaatggctagtgtttatgggagagagtttagcacaagacggagtgagacaagattgctggggtcttattttgaatccagcagccaacgctgtatggaatagtgaaaaagttgcctctttctgtgcttgttttctacttggtatctttaagaatgggctatttaggagcaaggagcctagcagaaagcatctgtcaatcttctaaaactttacctacaaaagttttactggcttgtgtcccaccagtgtgtttcaaagccagaaagtatattggccacaagcacctgtaggtggctgaggtgtgactgtagtcatccgtgagtcatgttttcagtatgtattgaaattccttatttggacttgatttcaaaggtagaagggccttttacaggtgaaggaactgagattgagacacatcaagagtctagcctcgagcttctgttcagtgtttttcccaaaattattgtttccttctggtctgggactctagagcaaagattgaaaactgtggcccaaagtgtgagccaaatccagccaccatgcgttttttttaaatcaagttttcctggaaaacagccaaacccatttatttggtattgcctatgtctgcttccatgctgcagtggcagagttgagtagttacaacagagattgcatggccagcaacacctaaaacatttattagttggccctttacagaaaacgtttgatgctctctgccttgcaacattgtgtacgtggtggtcagtgtgcttggaatcataggtgcaatgtaggatgcagacttagaaaacagtgcccttgctcccaaggaattatttgcactttagatgacaaggcatgtttgagacatgtgaaaggaacaataacaagttatgtaagagaggagacaggttctggactgcaggctatattttcagaccaaccagaatagttacgataatatcattaacataaataaaatactaagtatttagctacgtaaaagaaacgatttatttgcactttggattatacagttcttcattcattgattcaaaaattattgccagtctgctcatgtgccaggcattgttctagatgatagggcactgcatctctaaatgccaaatttcgtatccttgctggtggaaggcaatgtcctcttgctttatgccatgacacaaactaagctcctgctttaactatagacagctaaatcttaaacgaacacttttcagtcagtttagttttctcttaaagtactttaattccgttaaaacctgagccaccagatttcctgtctgcctgtctcttccttggccttaatccaaaactctgctgaggaagaagattcgttggtacactgacaattgttttataatccattcatttcataacccctcatttgctacccaaaagtggggacctaaatctgtacagatttacgtgttcaaaggccatggcctacccaaatagagaatatctcctttcttgtgtttctctcacaacttttgctgaagtctctccatctttgtgaacatgaacttctcgatttgtgaggctatcgctggtcagttgggtcattaatcctacagcaggcaagacacagaatttcctctcagctcaagatctcttcactcccaaccctcttagaacacacttcgcagcaatccttggaatctttaaaggtagccttttgtgactttaaaaaatacttttactatctctcaaggttacatccttaacagaaacaaaaagattctaatcagcgagacatcaagtctcttgcattgcttatttgtcacccaactaaaacaatgtactttcttgatttggttttattgactggatgaattatatatatacaaagattcaattagggaagcctctgaagtaagatgaagaaaaaagtatgaaactccagagaaagcagtttgaggcttatcctcaggggcttcaaggactgggagaagtcactgtattctggcatcttgcttctgtctccacttcctcccacagtgtttaatgctgctgtgaatttgtttcaaaggaagcctatagacttttttttttttttttaattttgtacatgagcctcaggagcagccttgacagctaaaagacctcgtaaaagagaagtgtgaagggattgcatgaaagtgctgggggcaagtctcagccctcggcctttgttggaaggtgtggggtgtgcagacacatgtgcaccttcgcacacatgcatctgtgcataaatatctgtgtttgcaggaaagaaaagatagggttgtgggatgtccccagaagccacagggattccagtgttttagtaccaggtgaaagagccgcttcctcccacactatctcagggagatgcccttctgtagacctctgtagcccagtaccctcaagagctcctggagacagatggccccgaacagtcctagggaagcagtgtgggcctgtggcaaaagcttggactgcgaagtcagcatgattggaatccggttcttgactcccaagcaggtgcataatgtccctgagcccttctttccttatctgtaatattgagaatagtaatacccatttctgggcccttttgactgttaatgagacaacatgtgaatgcatggcacaagaaagttaattgctacgtgtcactgtccccccctgcctcactgctgagctgccatcctgcccatctgagagggactgtgtgggagctgtgggtacagccagcacaactgcctgcagagccacgcagggcactgacagggaaggcctgtgtggggtgcccttcaaggccacctccgttttcttatttccttggagatttacttttgtgctcctgcttcccctccctgaagctttgcctgctgtccatatttggaggggatgaataagatgagcactggggaggggaggagccatcactccagcaggaatattcccagcggctgagtcactgcatttgattttcagtgtgaacaactgagaaatcaaagagccctaaaagaggaggaagtttcaggacaatgtttttaaaagataaaaaaacatcaacagcatggtgtctgagtggaaaataatagaaggggcttgaggagactggaaattccagtttgtgtaagggcgcacagtgctgtaatacagagtcctacctccctgcagtccctggatgtgaattcccaggctgcacccacacctgagcaaagcggaggctgggccttattaggttctgactgcgggctggatctcagctgcaggctgtgagtttcggataccggtgtttccaagccttctccacaccttatgtaatcacaggtgaaaaggtccagcctcatttgcagctgtggttcttctgccccaggaagccaggaagcgtagatttttgtattatttgcctccacttctccctcccccagcgtgccaccgtgcacatatgttttctgttttcctaagccacggcaaagcacaagcaattgcccattgtaaacacacctctgcgtatcaacacacacctggctgcactggattgaccaactttctgcttctaggtaatggctgatctagaatagaggaggaggaggggaaaaaaaaaaaaaacaagcagcagatggccccctgaatgttgtaaaccgtgtttctctaagcagggtttctcaacactctcgatatttgggccaaataataatttgtggggttgcttactatattgtaagagattcagcagcatccctggcctctacccactagatgctaggagcaccctgcaccccagtgtgacaaccagaaatgcctccagatattgccacatgcccccagttcagaaccatatttgtaaagcttagtagcaactttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaaaaaaggaaaaaaaatctattgtgtggtcaggcagttatttttatcatctaggcataatttttaccaaagaaacaaaacaatcaataatgttataaaagccacttatactctgagcttgaaacaactgctttatgccacaaaattcctattgctgtctccgttagtgactaattcaatatgtcctgaatgtcaacgtatttttattactcagctaaagttggctttgctggattaaatgtcatttaaaatgatcaattggcagcttgtttggggttgttttcacatttatgaaaggaaaagtttgccggatacaaatgttcttgaagctgatagggaaacggtgttctctggtaagccctgcccttccttttgccatctgataagtagataacattctaggtcctagtttgatgcctccgaaaaaccaacatggcagcccagtgcaggttaagcccttacattggagaaatggtctggttcacgtttcactgttttatgagaagtagaatgtaccattacagtaaaagagaagcaacagaaacatgcagtgaaaacgcccatgcttgtggttagagaactgtccgctttctttttgctctacagtaggcttctgagtggagtgccttccgcctagagtcaagagggctgccatgatgtcacccaccttcatatgggcaaaatgtctttatatgaaactgtaaaagacaaccaggtcgtttcttaattgctgaaatttattaaaatgaacacactagaaaatcacattcccaatccagaggaatccaatggcgtcgtcagcctatttgcaatggaaatgattgtaaacctatagggagacataggaggggctgcacacaaactactttcgttcgtcctgatttactggcttcttttccccctagagatacagtctcactctgtcactctatcgcccaggctgagtgcagtgggttgatcatggctcactgcagccccaaacccctgggctcaagcaattctcccacctcagcctcccaactagctgggattacaggcatgcaccaccacgcctggataatttttaaattttttgtagagatgaggtctcgttatgttgcctgggctggtcttgaactcccggactttcaagcaagtctactgcccctgcctcccaaaacaaacattgggattataattataagccaccacacccaaccctaatttacaggcactgtatgtgataatatgtgattttgtcagatgttttccagttggaagagattatggaaaattaaaatgtgtctgccatttgatagtaggacaaatactgaaatattaagccacagctgagttctggccttagtccttttggggctgctctgacaaactgccgtagactgggtagttggtacgcaatagatacggattgctccacagttctgggggctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaagggaaaaagacactttgccactttttactgctttgcttagaaactagaatcatcctccttcaaatgcctgtaaaacgagctagattattctcagtctgcagtaggacactgatttctcaaggtacttaagatgcttgggttgctcatcttctccacacccccacctcagcccatcccctggcaatacagaatgcagccatggcaagacggggtgggcaatagaagtggctggacagcttctgttgttagaatggggttcaaagtccaggactatggtgttgttgttttaagaaggaggccacttgtccttttccaaaacacaatgagtgacacaccacattaatgtttaaacacagataatacagaagaaaggattccataagggatactaaagatttagggctgctgtacatttaatggtagttccttgaaagattaagcttctggaaaatgccacagttttctgccagtgtcttctgctattcaaagagaacgctggagttcagaaaagatacactgagcaggtgtactttgttctggaaagtcctaagattttataaacatacacccattaacgagtttctctgagactagaaattgcattgggaagtgtgtcatagcatgggttttggggtcatgcacagccaagaatcctgtgtgtcattcataagctgtgtcctcctgagtaaatcatcaaaccctctcagccccagcttcctgatctataaaataggaatagcaacagcacctgcctcataaggcggcgtaagggtcagatgtaaccaggcttgtcgaagccacagcacagtacctacaaatagcacccactaaataccgttgttatttttattactttctcttccctcccattatcactaatataataatcctgtaaagtaagtgctgttattcccacttcataagtgaggcaacagaacctcaggaagattaagaagcgtgtccagggtggcccaactgaattccccttgtaaatatacccccagagaagggtgtatgtttctctgcaatgcggatgtgttggctgtaatatattccaagtctcaactggacactcccctttcaaatgtgccaggcctaggccttgcccaaagtaaaaaagaaagaacattgtagtgcaggagtccagagtgcaaatccttgtgacctcaggcaagttatttcaacctctctgaggatcagaaataatacaggtaaagtgccgagttcatacttgtaattcagtagttgatcttccatcaccagccattctgacaagtgcctataaaaagtgggcatttccagaaccatgcagtgaacacctggaaattggtgctgctcctcatctggaggccagttaacctttaactcaacctagaaggcacacatctgtccccagctgcctctccaggttctgctggagggcaaccacacaccttcacagcacacatccagaaagtcatagaacaaggggaaggtgtacatcatgtcttcttctttttttttttttttttttttttttttttttttttgagactgagtctcactttgtcaccgaggctggagggcagtggtgcgatctcgacttactgcaacttccacctcctgggttcaggcgattctcctgcctcagtgtcctgagtagctgggattacaggcacacgccaccatgcctggctaagtttttgtatttttagtagagacggggtttcgccacgttggtcaggctggtctcaaactcctggcctcaagtgatccacctgcctcagcttcccaaagtgctgggattacaggcgtgagccaccacgcccggccatgtcttctcttttaatttactagcccacagccaaaaaccaaggcccaacaccatgcctagtccatattaaatcacctaacacttaataaaatatccattgcctgactaaatgttcaaacatcagttctgcaagtggagaaagtgacttttgcactgggttcctttctgccatgatccactatatcaaaacattttttaaagacctccaaaatgtgatagaatgagaatatctgtatctctttttgaaaccatgctagccacagttcccacagtcagagtcaccaagccacatagtttttcttttcccaccatttttcactcctcactcctttttgctgtgttttagcctaccccagccttctcatctttatccatccatctcccaccaacaccaggataaccttttcactccactattttttaccacacagctctctctgtaaccatcaggaccctctttccacccttttttccttccagcctgcatttaacacacattcagagcccattgattcagttagaacttgcctcccgtctttcacatgggttctgcccaggtttaagtttgggtcacgaccgtggacttctgggtcactgtatcatcatctgtggagggaggctgtcgcctggatcatctctgaggcctccggtgggtcaaaggtcacacaacaggacctccctccatctttctgggcctccgtttcttcccggtaaaacaaggaagttagttagacaatcagtcaacccaagctaggcagaagcagttgctggattcttttttgattcttctggttagtgcctcaacaagaaacattttcaacagtgttttcttgcccttttcctctgtagactgtagactgctttgggattacgtctatcagttgctttctgacagccggtacgaaaacttcatccgatgggaggacaaagaatccaaaatattccggatagtggatcccaacggactggctcgactgtggggaaaccataaggtaaaagggcagcagatatctgctccataaactagtgccaaaatgaagtccttatccctggattggaggataatcgtctgtcttctgctttttacgtctgcccatacttatttagtttattccttgctgggcaagcaattaggcagttgcaaagggaaggaaataattaaagatgcatcttgccatttgttcctgagaccaggtgcccattaactcacatatcctggtttgctgggctgcatcatgagtgactcttgtttccactccccttgacctgatcccgccacctccactgttgttaggaactgggtaaaagggaagtacagcaagactctctgactcacaggggacctttgggaagtgccactacttttctgctcagttagaaactcccatgttccccaaagcccatttctttatagaaaatacttagattctgactgtaaaacatcccctttataagcaagcgatgcaagaagtttgccccacaatttcccaaactgggaggagggaatggaattgaataaagtcttttgcagtaaggaagactgctcaagtgcgcagttgtaaaaagcgggtaaccgtgatccaggccagtcgataggtggacctgaagcaaagcctgatgttggcatggtggcacaaccccaatccgctgagtgagtgaaaaggcagggaggcccagccaggtgtgcccagacctgcagccttctaagaaggcagtgggtaatgcagaccatgaccaaatatggcaaggccccactgacagacacttccatgtgtgagtcactgagaaaaatccctctgctactcccactgtaccattgcctcgggcccagaaccactgtattcttgcttccacaacaggaatttaaacaaaagaattgtcttccttaaaatgacagaccagaaacacaagtttgagaaaaggtcattgcaacaaaaaaaaagaaatgctgtgtgggtcagaaggtgaagggtgacccagagatagggggaacctgcaggaaattcctcaggcggagcagagagcggtcttgggaaaaggaaataagcgaggctgctatgggatctgctttattagctagggctccaggacttcggacaaagggtgattcaccttaggagtaaaccttggtgacagtgaatataaaaagctaaagggtggggacagatgtgcctggaaggcagccgattagcaggtagcttcccaaactggcagggccacaggcagcagctgaagagcttttattttaatagctcccgcagtgccttttctgaggttcatttcattgtgtctttgtgctttttttctcccttcctcctttgaacaaacagaacagaacaaacatgacctatgagaaaatgtccagagccctgcgccactactacaaactaaacattatcaggaaggagccaggacaaaggcttttgttcaggtagcacttcctttttctcctttccttcttttgggaggatgctgttttctttaaataacggggagtggggggagactgttaagatctctacctgcctatcggatacccaaagccaatcattgctacaaactggataccaggtactggtttgttaggatttaaggaaaatatttttttaacttatgtctgtcctgtaataaagccaaaactaaatgaacagaatctgactcacctttaaaataacgcagtgaccaaataatattatgtggcattaaagtccggtgtagttaaaagcacaaagtcaatggcaaaacaaggaattaaacctagacttccaggttaccatcgctgtaaggcaactttctgaaccagtatttgtcaaaatgcaggtaatgacccacagtgagtcatgaaatagattgaatgggtccatcagagctttttttttttaatgaaataaggataggataggatagagttgaaaatgccagactgcatgacatgtagcaagaatgacagttgattcatgaaaatgttgttccaggtgtgtatgtacgtgatgagtcatgatgtaaaatgtatttcttataatgcatcgtagtcagaataagtctacaagctgctgcactagaatttttctttccagaattcctcatagataatgagttccaaccaagttagcctgccaccacatagattgtaattccaagtactatgcaagagaggagaaagaactggaagaagaaggagggatctgaaggaccaatcaggagatgtagaagtagacctctggtgctggtggtagtcattagcggggccaactgcaggttggtagaagtgagatcaacaaacacaaccttgggtgatgagttttggcaggtgggccagaagagagtggcagatggggctagagatgtagattgtgaattatctatatacaggtaggaagtgataccatgtatgaacagatgagctcactgatatgattaatttattggaaagagcagagaatctggtctttagcattgggaaggaatggtaacttaggaatagtaaaagcaattaagatcttcaaaagaaacgggaaaggctcttcaggaaagggaaacagaatagaaggaataaaaaaagaaccctccattctctggctctaccgtatggcttttcttcatccttcaacctaaacgcagtccttggctccctttcttcccactctatacctttttcgtggatgaactgatcccgacacacaacttcatttatcacctcagtggttaggctcttaaatctctatatccagctctaaaatctccctgaaattccaaatttgaatgtccaagagtttcctgtaggctgtgtccccttaaatatcacatttaagtatttcagacatgacatcttcaaaacagacacttgtctcggattagaaattccacccagaggccgggcatgatggctcacacctgtaatcccagcactttgggaggctgaggtgggcagatcacgaggtcaagagatcgagaccatcctggccaacatggtgaaaccccatctctactaaaagtacaaaaattagctgagcgtagtggcatgcacctgtagtcccagctactcgggaggctgaggcaggagaatcacttgaacccgggaggcagaggttgcagtgagctgagatcgcgccactgcactccagcctggtgacagagcgagactccatctcaagaaaaaaaaaaaaaaaagaaaagaaattccacccagaattattgaattctttactcatcaggggcatcactgctgtttgaagcagccaactttgaaactacagttccctttgactcctcctgtatcccagtcattgtgctagatggaccattggctcttcagcaccattcccactctattctgtgttgcaggggctagaagcctgggaactacatttcccagaagggactgttgccagaagttcccaggttggagtctttcagtgacaagcagtttcatgagatctgggagactagaaaaaagtaaaggcttccctggcagtggaagctgatgtctggacttcatgattcacatcgggattcactcaacaacgtctttctgtctctagtccactctgctgcctcctgaaaccataatacaaactgccagctgccctacaacactaatacagttccctatgccagaaatgtatatgactaacttttgcctttttaatacctacaccctcaaggctcaacctcaagtctgttgccctgaatgaggccttcttcagctgctccaacacacatagctgtcgtcttccatcatcacctgggtttcctggagcccttaactacactacaatttgctttttcttttcttttcttttcttttttttttttttttagacagagccttgttctgtcacccaggctacagtgcagtggcacaatctcgactcactggaacctccacctcctgaatttaagcaattctcataattatcatgccgtagctaatagtagctggaattacaggtgcctgccaccacacctgactaatttttgtatttttagtggagacagggtttcgccatgttggccactcttgtctcaaactcctggcttcaagtgatctgcccaccttggcctcccaaagtgcttgaattacagatgtgagccactgtgcctggccaacttgtttgtttttctagagacagggtctcactctgttgcccaggctagagtgcagtggtgtggtcatagctcactgaagcctcaaactctgggctcaagccatcctcctgcctcagcctccggagtagctagagcgactacaggatttatattttgaatacaggttgagtatccctcatctggaatgcttgggaccagaagtgtttccagtgtttggattagggatgctcagcctgtagttttatgtgtcaagtccttctccccgacaactagattataagctcctagaaggtagaggattctattttttatcattctatattaaacctttcagttaatgcttattgacagcctggtgtggaatatcagaagcttaatatgggaaagtcgtcaaaagaagaaaggggtggtttggggggccaagcataggacatctgtggagttggcttagaggggctctttattgacttcggatgtggagggagaaattttagttaggggataaaagaggagaaaaactgcagatgctacagatcatactgctggagaagtttgccagtaatgagcaggaaaagcagtagtagccagaagattgataggcttccaataaaagattttcagtaagagaaaggaatagtgctattagtgagggagagattagtccattttgaggaaatgaatgttagaagccagacttgccacaaaatgaaggtttcttggtataagacctagtatgtaatcaagtgaggtgttgaattgtagatactctttacaagatgtttgagtgttgaagaagatggaggtttaagtgttgaaatcatggactagtgccattaagcagctctttgatgaggagacagaacacaaagaatgagtaggactcaactcgtgagaagagtcaggagggctccagataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagagaaaggtgtgcaggcacagaaggggactggaacgggtgctcctacagtgtaggtggaacatctgcaaccaggctgccttcctgagccatgtaaattatggtcaaaacatgtcactgatgtcacttccagtttaacccattgaacaggaagatgaggcttgctgtacaccccagttgcaaaggtagacagactaaagagggttcattgctggcattttgggtgaatcagtgataacattgtaaaagatttttttttttttttttttgcccttccaattttccagaagctccactaagttgtcctattgtcagcatttttcacttaacatttaactatatcctttgaaatttaagtaagttttgaataccatttcctgggctcacagtctggaatggaagtggatatacagctctcatgagtctgtaaaatctaattctgtaaaagaaagaacatatatacatggtctggaccaaggctttctcgtgtggtcatgcattaatgcaccacgtgatcccaaagggtgctcactacgtcacagacagcctagacttttttttttttttccaataattaggatttcactttgtcacccaagttagagtgcagtagcatgatcatagctgactgcagccttaacctcctgagcttaagggattctcccacctcagcctcccaagtagctaggactacaggtgcacaccaccgtacccagatttttttttttttggtagaggtggggtctcgctatgttgcccaagctggtctcaaactcctaggttcaagttatcttcccaacttggcctcccaaagcactaggattatatgcatgagctaccatgcctggccctagtctttttaaataagcattttaccactttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaaccatgaagtccagagtctctgtttttaataatatgaaatggagtcagacaaggtgctccgatgaggtaaatcctgtctccactcaattatggtataaagggcaatcatggtttttctctggcagcaagtctccgctgcagggcagtctgcaggcgatctttagacaagtggtaccggaaaggtcagagtgaaccattccaagctgagcagctgccacaggtggaagaattaccaagaggaaccgtgatcagagatgcttgggtcccatgctgtggtgaaggtttattagctcactgagaacttagcaatgccaggtcctcacacaatagaattgccccttaaatctgctgagatcagaggtctaagcctaccaggtgatgaaggcgtaagggctgggatagatcctatgactaaatacaggactgtaatgacctagaaggtcatcacacagctcagagccagcccacatgctcagaatgtcccagccaacctgaccaacagagccacccaccaaccagtgggcacttgggagttcaagatcaaacattctgcacttgaccagaactatctgccatcagaagtgggtggaaacaaggggaagaatggaagaggaagcaaatgcattgctgttgagcaaattgggcggaggttcaaaatgtctaagaaatcagcagtctcagaaaatgttcttagtttacttttgtctttaggttaacccagttactctgtatcccctgagaatgattgctgaaatttggccctatattctgtatgatcagagcacagtatcaaataagggtctagatattttttttgtggtgctaaaaatgcattcgaagctactatttctataatgcagcattagagaacttgctagaaatgcaaattatcagttcccaccccataaactgaatcagaaactttggagctgggacccagcagtatgttttaacaagcactctgggtgattctgatgcacacaaaagtctgagagtcactgctaccaatttcttcatcttagtatgaaagagagcttgtagcaatttaaacaataaactcaaaataattgatgacaactaatttgcatcaatagtactcacacacaataacgctgcattttcctaatggtagatatactgtggaatgaggctaagtggacacagaatcacataccaaagtcatcgtcttgttttctccaaaccttttaagcaatcagtttgctgtaaagatgagctgttttaaagggtaactcttaacagctgacctgcccttgcaaattagagcacagcaatttatccacttatgcccacttatctgcctaaccagcctgatctaaaaagaaaaataaaaggattattctcatctgctaactgaccttggctgtctgtccccggaattattaaacagagcctggatgagcatttagccagggcatttgcagaggactctagaaccactggactagaccagtgcttctcaaacctgaaagtgcttatgaatcatcagatctcagggaaaaaagcagattttgcttcagtagtatcttgggaagtctggacagaagatctgttcttctaccctactctctgggtggggcttgaggtgctgcactttttttttttttttttttttttttttttttttgagacagagtctcactctatcgcgcaggctggagtgcagtggcacgatctcggctcactgcaagctccgcctcccgggttcaagcaattctctgcctcagcctcccaagaagctgggattacagatgcctgccactacgcctggctaattttttctatttttagtagagacggggtttcaccgtattagccaggatggtctcgatctcctggcctcgtgatctgcccgcctcagcctcccaaagtgttgagattacaggcgtgagccaccgcacctggctgaggttctgcacgtctaaaaagctccaggtagtgctgatggtgctggtccagggaccacactgagtagtgagaagacagtctcccttcagaccctgaaatgctaactgtgatgcaaaactgaccgaacccctccctttgttgttttcctctgctaattcctccctagaatggtccctgggcccagtcctgctctgtgagaagtttgcttgttccctttcagggcagcatcaagagtaaacaacatgatcaaaagcctcttcaccaagtgaaggaacagctattcatgtactggaccttcatacagacattcataaccagatgcctcatggtcatcattcttatgggaagcaatgagaattccaagcatcactgcctctcagcctctagaaagaccagtcttggtcactgaaagcagacagaacactaacaatgccattcttgatgttctaaatggcatagataggatggatgagcagatcttccatgcaaacagtccaagatgctgacattaaaatcagataatcctgtttgttagtacttaacagattcactgttttcttattttttttaattaaggccttcagtctctgccagattaagatgatagatttctgttagtaaaaaccactgaggaacgtctgcttaatctcttctgagacaatagaagactatttcctctctccaaaccctctcagcagtggccttctggagtcctctgagatgttcatgccttttccctcaaccagaattttggtcatgagatcccatatcagaccatccacctgagttgacctttgcttcctccagtgcctctgggagagctaagtgctatctcggtgccccagctgcaagcacttctataaaagcaactaaatgcctccatgcagtgaattgctcatgtgcctctgtcccctactaaagctctctaaaggtagagtattttatgcacatttttactaccagccccttgcatggggctggcacaaggtatatgttaataagtgttttaaatgggagtgaagtcagagaaactctttgtgaccttaatttaggcaaagatttcttgaatatgacaccaaaaaatccataaaagaaaaaaatggataaattggacttcatcaaaattaaaacttgctcctcaaaacacaccatattcagaaaatgaaaagataagttacagactgggagaaaatatttgcaagtcatttgataaagaacttgtatccaggataaacttccacaactcaataagatgaataacccgattttaaaatggtcaaaagatttaaacagacatttcaccaaagaatttatagaaatggttgttaagcacacaaaaagatgctcaacattattagtcactaaggaaaggtaaattaaaaccacagtgagataacaactcatccacaaaaggctataataaagactgtcaataccaagtgttggctaggaggtggaaaaactggaaccctcatacattgctggtggggatgtaaaatggcacagccactttggacaacagtttggcagcttcttaaaaagttaagcataaatttgtcatatccaaaaaatttcactctgaagtatcttctcaaagaaatgaaaacacgtccacacaaagacgtatacacaaatatttagagcagcattattttactttattttgagatggggtctcactctgttgcccaggctggaatgcactgatgcaatcacacctcactgcagcctgaaacttctgggctcaagtgatcctcccatctcagccccctgagtagctgggactacaggtgtgtgccatgcgctggccaacttttttttattttttgtagaaacagggtctcgctatgttgcctaggctggtcttgaactcctgggctcaagcgatccacctgcctcagcttcccaaagtgctgggattacaggtatgcgccactgcacccggcccagcagcattattcataatagatcgcttctgtaatcctatcacttcgagaggctgaggtgggatgatcatttaagcttaggagttcagtgtgggcaaaatggtgaaaccccatctctacaaaaaaatttaaaaattagcagggtgtgttggcaaacacctgtggtcccagctacttgggaagctgaggtgggaggatctcttgagcccaggagattgaggctccagtgagaagtggtcacaccactacactccagcccgggtgacagaggaagaccctgtctcaggaaaaaaaaaaaaaaaaaggctgggcgcagtggctcacacctgtaatcccagcaactcgggaggctgaggcaggagaatcgcttgaacagggaaatggaagttgcagtgagccgagatcacgccactgcactccagcctgggccacagagcaagactctgtctcaaaaaaaaaaaagacaaaaaccagaaacaatccacacatccattgactggtgaatagataaataaaatgtagtagatccaggcaatggaatactatttagcaacaaaaaggaaacaaaccattgatacatgcaataacatgaatgaaactcaaaaacatattcagttatataaaatttccagtaaaggcaaatctataaagacaggaggagatgagtgtttacctggggatggaggtgggagtggggattgaatggaaacaagcaagagggaacttttggagataatggaaatgttctaaaattggatagtcatgatggttgcataaatctatacatttactagaacttattgaactgtacccttataaagaatgtgttttaaggtacataattttacttcaaaaaagctgttaatacaaaaaaaaaggaaaagaaaacaatctacataaatcaattcacgctggttgtatggtaagtgggactgtcttcaggagctgcacataggactcaaataaaggaattatagaaaaatatactaataatgtaatatactaataaaaatgaaacattaagagaaattatgacagcaagaaatcaattacattctgttcatcaaccaacctccccagggctaggcctctcaacagtccaggaagtctgagtaaaccacggctctctcagaaatactttaaactatggacaccccagaaggaaccccagaaacacacagcccttgatggccaccccctgccagcatcaggtggctccaggcagttgtatagacagcggccctaatttgaactggtagcctaggatattggaagaccatttgatgctgagactccaagtcatagattcttaaagctacacagcaacataaaggccatctgaatcagtaggtgtttgtttgtgttatgtgtggccccagggcttcccaaaggggataaggagcaatgggggagaaatgcctcaggaatgaatctgggagcctgagaaggacccaactgaaatcagacgatgggaacaccaagcagggagatggtttaacacacctgtgggctattattcttcaactatgaaattaacatctatttagttggggtgaagagcaaattattttttactcacaaaaatgatgagacttttagccaggtgtggtggctcatgcctgtaatcccagcccattggaaggccaaggcaggtggatcacaagttaggagtttgagaccagcctggccaacatggagaaaccccatctgtcctaaaaatacaaaaattagctggacatggtggtgcgtgcctgtagtcccagctatttgggaggctgaggcacgagaatggcttgaacctgggaggcggaggttgcagtgagccgagattgcatcactgcacttcagcctgggtgacagagcaagaccttgtctcaaccacaacaacaaaaaatgatgagacttttatgtacaaaataagaaatgcattatatgcactgaaaatatcattacatttttactttatctaaaactatctcaaaagatagtatctttccattcataacagtcatgtataaaagatggagatatattccatgtctactataatgcaaaacatcttcaaaatgtgttttaaaatgatttcctctgtctgtcatgttggtaaaacgtttttcactgttctgtagttcatattccctcttctctttccttttatgaatatctgaactaggcagcctcttgggaagtgtatgaaagacttctaaaattagataataaaataaatcactcattcctgataaatagcattacacagtcaatcattttgtctcagaactttagcctattgctactgtagggaaaactttttgaggccatggtctcaggaccaggggaacagcctgcaatctcagcacgtgctttgctatgtggggagcaaagctgtcatcagagatagggcagtactagaaaggatgttggttttgtccacccgagaattctgtctgatggacaatgtctgaacgtcaatgtccaaatttcattttgccagtcacatcaggaattctagacagagactagaagttcattggtaccaagtttctgctttatgcccttctgatttagtgtgcctgacataggctggtgcccaacacagctggctggctggcctgagagcaacagcacaggacacttacacaggtgcagtctgcagtcagagtgcccggatccaagtcccacacctgctgtcactagctatgtgacctcaggccatgaacttaaccacgctgtgcctcagtttcctcaaatgcaaaatcgggatgatgataatgatagtgcccacctcagaaggaaggttgtggggattaaaggaggtattacagagaaagtgcttaggaaagtgcacagcacattccatattaactgctatgacttctataattaagtctggatctactgagccaccaaccactgcttcactcagagcagctctgcttttatcatttctacacattgggattccaccaaaagacaccttctcataaaaaagtttccatggtttttgttttgttttgtttcagtttgaacatcatggaaggattacaaccccctcactttacaaatgaagggtcagaggcccagcgggatgaggggctaccccgagtcctcccacaccctggggttgtctgagcctgggcccccgcctggcattctcacttcacctcccttcatggggccacattctcagtctcgaagagcacctgagtgcccagtgatatttatttgtgccaatggactcaacccaagggaaatattggcttgactcaggtttacggagaatattttgatctggttttgttccagttcaatagctttaggaaatgtgtaggtttcgttctatttaaaatcagtacgccaaactctttgattttgttttctctttctttttaagaaagtcctgactcagctaccctatgcacaaaactatattatttgggttcagttttggggctaggaaatttgaacaccacttcaaaaaggagccctgaatgtggagaagccacatcactaggccctagaagtcttgccgtttgaggaaccaggggatcaagctgtgagaatctcccaaccatcttgctccctgctggactcttgctttttttttttttttttgagacggagtttcactcttgttgcccaggctggagtgcaatggcacagtcttggctcactgcaacctccgcctcccagtttcaagcgattctcctgcctcagccgcccaagtagctgggattacaggcacccgccaccacgtccggctaatttttatatttttagtacagacggggtttcatcatgttaacctggctggtctcaaactcctgaactcaggagatcagcccacctcagcctcccaaagttctagaattacagatatgagccactgcgcccagccttttgctagaaaaggaaaaggtgcacatgaccaggttgagaatatcctcttttgcaacaggaagaacagcagccacactgtgtcccatctaaccactatctcaggcaaatcacctaaggttggagcctcggtttcttgtagaattattttcctcaaagcaccatggaaataattcaatgatgaaaatgggtaacaatcctaacccatacatgatagttcccttccctctttcctgcctgctaaatcctccctgcaacacacatccatactgcccttccagcactaattttctgtcttctaattctgtaaaattatgaatgggaaaatcacccaatgacaattgccgaggtatcttagaccttttgtttctaatcaactgaattgccacttcacctcttcaagcgatgtatagcccttagtcaagaccttggccaaaataaggtaattaccttttgacacaacctgggaagtcagagcatccttcctccgccagtctccgcaaagaggagcctcccccaagactagaaatccacacgctcttttcccactccacctcttcctcctagtaaaagtctgtgtgtgccgtttgcatcggcttgtagctggttagtcaaatcaggagatgaacgcaaattctccaagaaatttgaaatctgctttgagcaattcagtttggatctctttcgtttcctttccttaacagcccccaatacttgttccctacctgaggaaaacctaggagggcatggagatggctgtattcccagaccaaagattttccatttaaaggaaatgtggggtctggtttggtctgtttcagtgtcatcagggttttaaacaatcaaataaatctcccttgctagtagatacttcattctctgcccctgctcccaggattcatcaccatagttatcttcaaacatcacctcggtgccgatgacgacatggcacctggccaggtgtgaaggaaagtcaccttaaggaccttccctgtgaagggtataaacttggactcaaatacaacatgagtaggggaagaggtggccacttagggacttctgggccaggccacctggctgagaaatttgccatgaggaatacctagttcacctctacacgtagctataagggcttcttccacttcagacatgtgatgtggcttacgcaacagtcaagcaggaattatgccaatataaaataatcatgcagtgtcatgatgtagctgctcctttagtctcccccactttataattttcggtgccaaccattggatgagctcaagcttgccaaggcacattccctttccctctgtgtgccccacagaggacccagttactgggagaccactcagccctcattgcagttctaacaggtctagcccaaaggccttcaggctagtcaacttcagattactttggaacatgcttgctctttgttttttgagcacattttgaaggagatccagatgcccggggtggagtgaggctcctaaggtacatcattaagctttctcagggaagtaagatcagggtggtatgggaaaaagagcaccagctttggaatcagacaaagctgagtttggaacctggctctaccacctacagcaatgccatcttggaaaaagtgcccatgattcttgagtagccatttccttctctaggatttggaagggtttctttgaaaagcagagacactgtatgtaagttgcctggcacacaatacacattcaataaacaggactcattatattcatctgggtgggttctttctccggaaagtggatggatagccggataggggaacttgtatccaaaaatcttatttcccactcatcaaatcttaccagttactctcttcacattttcttctctttccccttcatcattcaaggaaaaaaaattggcggggcacagtggctcacacctgtaatcccagcactttgggagaccaaagcaagagggttgcttgatcctaggagtctgaggccagccggggcaatatagtgaaaccctgtatctacaaaaataaaaaataaaatagctggatgtgatggcccatgcctgtggtccctgctactcaggaggctgaggcaggaggattgcttgagcccaggaggtggaggctgcagtgagctatgatcacaccactgcactccagcctgggcgacagagtgagaccctgtctcctaaaaaaaaaaaaaaaaaaaaaaaaaaaaccagaaaaaaaagtttaaaaagaagcaactttagcacagtgatcattctagatgtctctttttccaaatgaactggcctcaaaatcctttatccttgcacagtacttacaaagagtgcttgcttacactgtatctataacctcataacaaccccattaaaaatgttttctctctcattttaagaaaaaagaaactgatactcaggacagggtaaattacttggtcaaattcacatagatagaaagcaggaaagcttggtttcaaatcaagatcctctgattcctttttacatgttctgttatattattcaggaaaggaaactctttgaaccattgtcagcctttgatacagatgtttcttgaattggttagcagagaacagagctcttaaagagtgttcataggacaagtaagtctgattggaggaaagagtcagacatggcagtgatctggaatttggagtcctgagaagtaggtaggggtgccagtggtgtttcctaagaagggaagaggtagtatgagagcactcatgtcatgaaatgtggtgtaccaaagaaaggaaacatatctgaaagagatatggaagagtatggaaaatacactttcccaaagttataatttcaccttaggccagtcccatctctctactatattgacttcttaaacctttccaaccttttcatgtccttttctcaggaatcctgtcacccacaagaatgtagcccactttgttcatagactggaaatggctggggacacagcagaatggaagcccatggttccaggtgaggccgtctggaaagagagagtctggtgaagggattaaggaggaaaaaaactctctggtgaccgagtaggcacaggttagcacaatgctaggggaggagcagagggctaccaggtagctgaagtgggtacagcccccagatttcaagaacataaaccctgagggtatttgaagaggaaggagtgtgcagctaaatacagggtgagaatcgaaagattaacagaaacagcatttaagagtgaggacaatcaaaatcagaagtgtcagaggataacaagagaggaggaggctgtttgtgtatacttgtgtacgtgtacttgtgtgtgtgaacagatgacaatattaccacagcagcttcaaccccacttcctgttgaagagtgtttgtatgtcactaaaggtaccattcaagtgatgggaacatagaatgttagaactagaaggaaccttagataatttcacataaattagaactctcaggaattgagtgactggcctaaagtcacacagctactcagtggcattgctagcatgcctctgtacagttcatcgtctttggcacacagagtcagaaaaatacttcagcaaggaatcagaggaaaagaattaaaaacactcttcaaaagccaccaaccaacagcacaaacaagaagacagaaagaagagaggaaaatgttccagaacgcacaagttcagttacgaaaagtaccacacaaaaagacaatttagtcttaggaaaaacagacactcaaagcagaaaaggcataaaatactgtctcagaaagaaatgcaaaaaacaaaaaagattaattttatggacagcttgatgccagagtgtgataataaagtgcatgccataaatatttgattttgtgtgaagaaatacagggaactggtttgtgtgagaggaaggaggtttgggtggtcactgaaatttaaatcaaaaaagaagatgaataagcctagtttgttaggtgaaagcctgcagttgggtgctccaaaaaagaagctttcagtaggtttctcagtgatttataaatacacgtggacagtttcagaaacaaagtatctactagagctataaactagtccttggttttcactcttgccccagaaatggttagaaatgaaatacgtgtttaacaagtatttattaagttctcatcatgtgctaatacctaaaattgcaaaactttaaacaaaatgagattaaagcaaaagttgtaacgttgtaatacacagagatgtaatgcacatgacaactaactaatttgacatctatatcaaatagatataaatgacagaggggtaggtgataaactgaactgtaagactatcaggttcctacattttacatgaagtgataaaatattaactctatgactctaaaaagttaggaatatatattataatgtctaagcaatcacttaaaatgcaaaaagactaacagataaattttttaaaatattaaattaacccaaaaagagccaggaaagcagtacagagaacaataacagatgagacaaatagaaaacaaagaaaaaatatagacctaaatgcaatcaaatcaataattacattaaatgtaaaaggactaaacattccaaataaaagacagagattgtcagaatgggtaaagaagtaagacccaagtatatgctgcctataaaagacacagttttaatatagggacacagataggttaaaaataggaatagaaaaaaaatataccatacaaacagtaagcataagaagactgaagtggctatattaatgttggataaagtagacttcagggcaaaaaaaaaagtattagtggagataaacaaaatgggagcctctggaattaagcattagttttctaactacagaacctaaataatcaaagaaagccaaagtgcggctggggggaaatgtagtacgtacagcaattttcccaaattccctgtagtttattttgaaaataatttaagacaacttggttcaatcatacttaacttcctgagttctcactaggaaagataaaaggaaaatttttgaagaataggctcttcaacaagaagggaaacctggaaacactgagctgtgtggactctccagctttatgtataattgacatgaacggggatgaccaactatttgtttaacaattatttattaagttctcatcatgtgctaggcactgggttaagcatttggtgaacaattcacacctagccccttccctcatattgataaaacaaaaaagccaacaagtcactataccagctataaacagtgataattactttttcttaaaattttgttttcctttgattctaagggtacatgtgcaggtttgctacatgggtgtattccatactagtgggaactgggctcctagggtacctgttacctaaatagtgaacactgtacctgatgggtaattttttaaccctcaaccccctcccaacctcccctcttttggagtcctcagtgtctattatttccatctttatgtacacgtgtacccactgtttagctcccatttagaagtgagaacatgcagtatttgcttttctgtttctgagttaattcacttagcataatgaccttcagctccatccatgatgctgcaaagggcatgatttccttcttttttacagctgcaaatggtgataaatattatcaagaaaatactcatgatgctgagatagagaataccaaatgaaaaaggaaacctgcctaggatagcatgatcagagaaggggatcagaggaggtaacatttaggaagaggctgcaaacagagacaggggtgaggtcaggggaacagtgtgtacaaaggcattcagggaggaaagagctaaggagtttctaaggaactgacatatggccagaatagctggagctcagagtaaggcaaacaaggaccaaatcttgtgggtgagctctaccaaacctccaagggacataaaatccaaccttatataaaattgtccaggggaggagacaagatggctgaatagaaatagctccggtctacagttcccagcatgagcaatgcagaagacgggtgatttctgcatttccaactgaagtaccaggttcatctcactggggagtgccagacagtaggtgcaggacagtgggtgcagcacaccatgtgcgagccgaagcagggcgaggcatcgcctcacctgggaagcgaaaggggtcagggaattccctttcctagtcaaagaaagctgacagatggcacctggaaaatcaggtcactcccaccctaatactgcacttttccaacaggcttaaaaaatagaacacaccaggagattatatcccgcacatggctcggagggtcctacgcccacggagtctccctcattgctagcacagcagtccaagatcaaacttcaatgtggcagcgaggctcagggaggggtgcccgtcatttccgagttagttgtttgattaggtaaacaaagcggccgggaagctcaaactgggtggagcccaccacagctcaaggaggcctgcctgcctctgtaggctccacctctgggggcagggcatggacaaacaaaaagacagcagtaacctctgcagacttaaatgtccatctctgacagctttgaagagagtagtggttctcccagcacgcagcttgagatctgagaacgggcagactgcctcctcaagtgggtccctgtctcccgagtagcctaactgggaggcacccccgagtaggggcggactgacacctcacacagccaggtactcctctgagacaaaactttcagaggaacgatcaggcagcagcatctgcagttcaccaatatccgctgctctgcatacacaggcaaacacaggctgatacacaggcaaacagggtctggagtggacctctagcaaactccaacagacctgcagctgaggctcctgtctgttagaaggaaaactaacaaacagaaaggacatccacaccaaaaacctatctgtatgtcaccagcatcaaagaccaaaggtagataaaaccacaaagatgggaaaaaaacagagcagaaaaactggaaactcttaaaatcagagcacctctcctcctccaaaggaacgcagctcctcaccagcaacggaacaaagctggacggagaatgactttgacgagttgagagaagaaggcttcagacgatcaaactactccgagctacaggaggaaattcgaaccaatggaaaagaagttaaaagctttgaaaaaaaaattagacgaatggataactagaatgatcaatgcagagaagtccttaaaggacctgatggagctgaaaaccaaggcacgagagctacgtgacgactgcagaagcctcagtagccaatgcaatcaactggaagaaagggtatcagtgatggaagatgaaatgaatgaaatgaagagagaaaagaagtttagagaaaaaaagaataaaaagaaatgaacaaagcctccaagaaatatgggactatgtgaaaagaccaaatctacatctgattggtgtacctgaaagtgacggggagaatggaaccaagttggaagggacagtctgcaggattttatccaggagaacttccccaatatagcaaggcaggccaacattcatattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagccgatcagactaacagctgatctctcggcagaaactctacaagccagaagagagtggggaccaatattcaacatccttaaagaaaagaattttcaacccagaatctcatatccagccaaactaagcttcataagtgaaggagaaataaaatcctttacagacaagcaaatgctgagagattttgtcacaccaggcctgccctaaaagagctcctgaaggaagcactaaacatggaaaggaacaaccagtaccagccactgcaaaaacatgccaaattgtaaagaccgtcaaggctaagaagaaactgcatcaactaacgagcaaaataaccagctaacatcataatgacaggatcaaattcacacataacaatattaactttaaatgtaaatgggctaaatgctccaattaaaagatacagactggcgaattggataaagagtcaagacccatcagtgtgctgtattcaggaaacccatctcacatgcagagacacacataggctcaaaataaagggatggaggaagatctaccaagcaaatggaaaacaaaaaaaggcagggtttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagaaagtccttagtgacctacaaagagacttagactcccacacaataataatgggagactttaacaccccactgtcaacattagacagatcaacgagacacaaagttaaaaaggatacccaggaattgaactcagctctgcaccaagtggacctaacagacatctacagaactctccaccccaaatcaacagaatatacattgctttcagcaccacaccacacctactccaaaactgaccacacagttggaagtaaagcactcctcagcaaatgtaaaagaatagaaattataacaaactatctctcagaccacagtgcaatcaaactagaactcaggattaagaaactcactcaaaaccactcaactacatggaaactgaacaacctgctcctaaatgactactgggtaaataatgaaatgaaggcagaaataaagctgttctttgaaacaatgagaacaaagacacaacataccagaatctctaggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggacatagagacataaaaaacccttcaaagaattaatcaatccgggagctggttttttcgaaaagatcaacaaaattgatagagcgctaccaagactaataaagaagaaaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctcaacacatacatccttccaagactaaaccaggaagaagttgaatctctgaatagaccaagaacaggctccaaaattgaggcaataatcaatagcttaccaaccaaaaaaagtccagcaccagatggattcacagccgaattctaccagaggtacaaagaggagctggtaccattccttctgaaactattccaatcaatagaaaaagagggaatcctccctaactcattttatgaggccagcatcatcctgataccagagccaggcagagacacaaccaaaaaagagaattttagacctatattcttgatgaacatcgatgcaaaaatcctcaataaaatactggcaaaccgaatccagcagcacattgaaaagcctatccaccacaatcaagtgggcttcatccctgggatgcaaggctggttcaacatatacaaatcaataaatgtaatccaacatataaacagaaccaaagacaaaaaccacatgattatctcaatagatgcagaaaaggcctttgacaaaattcaacaaccttcatgctaaaaactctcaataaattaggtattgatgggacgtatctcaaaatcataggagctatctatgacaaacccacagccaatatcatactgaatgggcaaaaactggaagcattccctttgacaactggcacaagacagggatgccctctctcaccactcctattcaacatagtgttggaagttctggccagggtaatcaggcaggagaaggaaataaagggtattcaattaggaaaagaggaagtcaaattgtccctgtttgcagatgacatgattgtatatctagaaaaccccatcatctcagcccaaaatctcctcaagctgataaacaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaagagaactacaaaccactgctcaatgaaatagaagaggatacaaacaaatggaagaacattccatgctcatgagtaggaagaatcaatatcatgaaaatggccatactgcccaaggtaatttatagattcaatgccatccctatcaagctaccaatgactttcttcacagaattggaaaatactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccttcagaaataatgccgcttatctacaactatctgatctttgaaaaacctgagaaaaacaagcaatggggaaaggattccctatttaataaatggtgctgggaaaactggctagccatatgtagaaggctgaaactggatcccttccttacaccttatacaaaaattaattcaagatgcattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagagtgggagaaaatttttgcaatctactcatctgacaaagggctaatatccagaatctacaatgaactcaaacaaatttacaagaaaaaaacaaacaaccccatcaacaagtgggcgaaggatatgaacagacacttctcaaaagaaaacatttatgcagccaaaaaacacatgaaaaaatgctcatcatcactggccatcagagaaatgaaaaatcaaaaccacaatgagataccatctcacaccagttagaatggtgatcattaaaaagtcaggaaacaacaggtgctggagaggatgtggagaaataggaatacttttacactgttggtgggactgtaaactagttcaaccactgtggaagtcagtgtggagattcctcagggatctagaactagaaataccatttgacccagccatcccatcactgggtatatacccaaaggattataaatcatgctgctataaagacacatacacacgtatgtttatagcagcactattcacaacagcaaagacttggaaccaacccaaatgtccaacaacgatagactggattaagaaaatgtggcacatatacaccatggaatactatgaagccataaaaaatgatgaattcatgtcctctatagggacatggatgaaactggaaaccatcattctcagcaaactattgcaaggacaaaacagcaaacaccgcatgttctcactcataggtgggaattgaacagtgagaacacatggacacaggaaggggaacatcacacactggggactgttgtggggtagggggagaggggagggatagcattaggagatatacttaatgtaaatgacgagttaatgggtgcagcacaccaacatggcacatgtatacatatgtaacaaacctgcacgttgtgcacatgtaccctaaaacttaaagtataataataataaaattttaaaaaatgtccatatagtagaaaaagaagtaacactttccttactcatttacaaggctaaccttgttgccaaaaccacatgaggataatacaaaaagaaatggaaaattatgagacaatctcgctcatcaaatagatataaaaattccaaatccaacaaatagtaatatttacataggccctgggaattattatgaaatagcccaaagcaccttggaaaactggtgtaacaattcattgtcgcttttcatactggaatatgctttcataatgtttttcactggaaaatgtgtacctgactgagatgcaaacaagcttttaatagattgcacttaggtcctggaaacactagatttcagattgtatattgcagaagagaactggccctatgcaaattcgtggataggtaaattttgcctttagaacctagtctgctcctctccctaccctctgcccacaacttcaccttaaatggtcctattacctttccctctggggaaaggctttggggtcagggttggccatttactagctgtgtaatctctcttaaaacagtggcaatatataattccttcagctgttatataatgacaaaataaaataatacatggtagatgtgtagtacagcacttgggaagtagcaggatctaagtcattttttttctgtttgtagaatgaaagatgttgctctatgttctgggattgctggcctttcaggagcagagaggtatgatagaaaataatgccttcaatataaaattttaatgacttacatacagagtaatccatcaaccagattccaaaacatactttgaggggcaagtatctgttaaaggcttaattttatttgttcccagatagttcgaattgcctttgacagtcctttttctatcataaaaaccatctctttcttttacaagtctcagctgcttatatccaacaaaataaaagcatctcattaaacctcagccctctttgatgactcaacaaatattcattcattgaacctattaaatgtaaacatattacttttaaaaaacatatcttcaaggtcattccttggtccatccaagtgagtatcattaaatccatacccaagccatctaacacttgatatcataggagtgcataattcagtcagaaaggtggcctgcaaaagcagaaccagatttccatactcaaaaagaggagttctggcccggtgtggtggctcacgcctgtaatcccagcattttgggaggccgaggagggcggatcacgaggtcaggagatcgagaccatcctggctaacacagtgaaaccccatctctaccaaaaaaatacaaaaaaattagccaggcgtggtggtgggtgcctgtagtcccagccactcgggaggctgaggcaggagaatggcatgaacccagaaggtggagcttgcagtgagtggagatcacgccactgcactccagcctgggcaacagagtgagactccatctcaaaaaaaaagagttctgtttgtctatttcacaactaaataaagcatattgatgcctttgtgaactcccaatgcctagtttcccactttcaattctgtagtagagggggaagtaacagagtgatttggagtatatgacatggctaagacattcatcatagatccatcactgggtaggatgtatatcacatcacaggaagcttttgctcagtttttttcctatagctctttccactgtggggcactccagccataaagagggaagactatcttcttctttttttttaagacagggtgtcactctgtcacccaggctggagtgcagtggaatgatcacaatcacggttcactgcagtctcaatctcccatgctcaggcaatgatcccacctcagcctcctgagcagctgggactacagtcacatgccaccatgcctggctatttttttctattatttgtagagacaagatctccctatgttgtgcagactggtctcaaactcctgggctcaagtgctcctcccacccttgtctcccaaaatgctaggattacaggtgtgagccactgcacccatccctttttttttttttttttttaacattcctagatactaaatttcaaaccacaactagcccaaaattagctctgataacaagtgcttgactggatgactgactgcttatttctatggatactggttctccatgacagttatttggattctgatatgatgcctaattattaacgtactccttgcctgcttcctatcccaaaacaaatatcttaagctccaggaaggcaggactgtgattgactcaggacatccatgctttactgtccttgccactgggaaagaccctcagggaagaggatcaagacttaactgtccctgtgggagctctggagaaatgaacccaggatgtaaggctaatctgatcatctgaatcaccaagtctagacggggaatggcaacctgggatctgagctatgcataaatcaacagccaagagtcacacctggtggcctgggggacttaattaagtagggggtagagttcttaacgatttgggctcttccacatcaccgcagatgacttctgtggtcctatttctaaggcaggtctgtctggttggaggaagagaacagccaataacttgaggacatgaaaaaccaaaatcagaccccccagataaagagatcctgttagacccaagactttctgttaatgatttaattcatattcaacaggctgaatagatcaaatgtaaacatattgcttttaaagggcacttttgtccttccttgatccatgtaagtcgatctttccactggcaagattcactgagaaaaagaaagagttgacaatgcattctaaataattttgacctcttcttggttgtaccccatccagtccagttgtccagccactcattagataaactagttcagcaatgactaaaattgttcatcagccctgctacctaagtagaccctatatcctcacagccatccttactcctccctgttataaaatatctccttttcctccccttagaaacagagatagagtaccagatgcaaatgttatgatgaaatccagctcaagtggtagtgatctgtccagttttgtaaaggcaacacctgtgcatactaggaccagtctctagttctgaaacccacctacagctttaattatgtcacctactggaatcttccttcagattctaccttgctcctctactggcttccagagtatgagtccttatgaccacagtcttcctctgaggtgacctccagcctctgccaagctcaactcttgccaatgagccaacgttcttagccccaactacacgtagactcagctcagattctacccaagtccttaagcgtgacattccccaggaaatataaaaggtagaatgcactgtacctaaatgcagcccctaggacgttcatttcagtaacatcttcatgttgcaatactcatgagagggctttgatccttcacaccaatcgctaataaaaagctctcagctgggcgcggtggctcacacctgtaatcctagcactttgggaggccgaggcgggcggatcatgaggtcaggagttaaagacaagctggacaacatggtgaaatcccgtctctactaaaaatacaaaaaattagccaggcgtggtggcgggcacctgcagtcccagctactcgggaggctgaggcaggagaatggcgtgaacccgggaggcagagcttgcactgagccgagatcgtgccactgcactccagcctgggcgacagagcgagactctatctcaaaaaaaaaaaaaaaaaaaaaaaaaaaagaaaattagccaggcgtggtggcacatgcctgtaatcccagctactcgggtggctgaggtaggagaattgcttgaactcacgaatcagaggttgcagtgagccgagactgtgacactgcactccagcctgggcgacagagtgagactctgtctcaaaaaaaaaaaaatgcttagctctctgggcagccagcccattctcacctttacctaatataaatctgtaccagggtgagaatccaggaagcagagggtccgaaaatgtgcttctttcttctaaaaaggaagacacatattccccagatcaaattaaaaaaataaatccaggagaaaatacttgctctttcctaacttatattcataaggttctcttagtggacttctgtagccttagtgaaacccaaactagaatgtttagcaaaatccccaaatgtatcctattttcaatattttcagaactcaatatttttagaatgtaaaattgtgttttataaagaaataattcatttgtcatgtacattgatgacatgaaatgtacataaaattcagaaaactgaaattatcagttaacagggaggttaatagaattatttttacagcaatttagattcacagaataattgggaagaaggtacagagacttccaacatactcccctgaccccacacacgcacagcctcccctactgtcagctctccctaccagagtggtgcttgttacaattaatgaacctatattgatacatcattatcacctaaagtctatcatttacattagggttcactcttggtattgtacactctgtgagttctgacaaatgtataatggcatgcatcagccaatgtagtatcatatagaatagtttcactggcctaacaatcttgcgctccacctattcatgcctccttccccctaatccctggcaaccactgatctttttactgcctctatagtttaccttttccagaatggcatacagctggaatcatacaacaagtagccttttaatattggcttctttcagttagtaataagcatttcagtttccttcatgtcttttcatggtttgatagctcatttcataatattcccttgcctggatgtaccagtttatccattcactaactggaggtcatcttggctgctttcaagtttttgcaattctgaataaagttgctataaacatctgtgcacaggtttttgtgtagacataagttttcagctcttttgagtacattccaaggagtgcaattgctggatcttatggtaagagtatgtttacttttgtgtgaaaccaccaaactatcttccaaagtggctgaaccattttgcattcccaccggcagtgaacgagaattcctgatgctccacatcctcaccagtatttggtgttgtcagtgttctggattttggtcattctaataagtatgtagtggtatctcgttgctttgatttgcatttccctcgtgacatatgatgtggactatctttttgtatgcttttatgccaactatgcatcttctttggtgaggtgtccaagtttttgcccatttttaaattgtggtgtttgttttcttattgttgagttttaagagttcttcgcatgttttgggtaactgttctttatcagatgtgtattttacacacatttctcccagtctgtggcttgtcagattctcttaacattatcttttaccaagcagaaggttttaattttaatgaagtttagcttatccatttttttcatgaatagtgcctttagcgttttatctaaaaagtcatcactgaggggtgttgtgcttccagacagtgctgctgcgtgctagtgcccgggtccctcaaaaaagaatcttttaaaattttttaaataataatgtcatcaactaacccaaagtcatctagacattctcctatgttatattctgagagttttatatctttgaattttacactgaggtctgtgatccattttgattagtttttgatgagggtataaggtctatgtcaaagttcaactttttgcatgtggattccagttgttctggtgtcaattgctgaaaagactattctttttctactgtattgcctgtgttgttttgtcaaagatcagttgtgtatttctgtgtaggtctattttggggctctctagtctattccactgatctatttgtctgttctttcactgataccacactgtcttgattactatagctttatattaagtcttgaggttggacagtgtcagacctctaactttgttcttttccttcaatattgtcttggctgaatgactttttaaaattaattaaaacatttttggatagaaactttgccactggtataattccttggcttatgaaacatatatttatgtatcttaatttttaatgactgagaaatgtgtattattctttgccatcacataaaatgaccccagattgtattatcttttagtggttttactatttctataacctattccttttgttctcaccccttcagttcctccaagcctctctccttcataccatgtaattaagtgggaatcagtctaggtttccaggggaaccttattttacagttaagtttaagatagctgatctaagagttcctgaggagaattttttgtctcttctgtggaatgaattatcctcaaaagttctagattcagaggcataatccaggcagccatgatacccaagagccttacgtcaagttgtgaggcactattctgatacaactataataatgtcaacagtaattagcagctaaatattaaatgcatcactcttcaaaaattcagcttctgggaaattttccccttcctttcagttttccccccagttcacttttaaaaaaataagcaacttgagctccctctgaacttctaaaactatttaatacatgtcactcttaaccatcacccaaacctgcatctatcagtgacacattccccctcaaatcccccacccagacacctgcaggttacttttcaatgcatctttgcatctcgaaatctgggaaggactgtagcttgggaaaaattacacagttgagggcttagaattgatctaatgaaagttgataagacttatttgcctgggtcattgatttgtagccaagcccacttcaatgagtccagtttctatgttatcacttttcacctttcatcaagagcaggcactggagggacaacggaatccacaaagccagtattgttgactgtgattaaaaagagtgtgggattcactttctcctacacaagggggaaaccgaagctgactcaactaaaaggagggcaaaaggagtcctggccagtgtcacctcacctggagagaggatccagagaagactggggtttccattgtgcagtgtctggggaatgctagaagaacagggctcttattgtttcacttccagcacttaactaccaaagatgagagcttcctttctacttattacccagagtccagagtcactgggagaggtaatcagatcatactgtaacatcctttgaactccctggagagcttgtgctacagtaaagcatgtgggatccttatcaactctaattctctggggtcttcctctgccatcaatttcacctgtgcagagtcattcaaccttgttcagtcattcattctttgctgctgctgtttgtttcaagtccattagaagctcattccaggaagcagaaactaacatagaaaccagtgtcagcctcctgagctccaaagcacacctgacccagggatggggggtggttagttagcatgaagtcaacctctttccaaatactaaagtaatcatagtacaaacggattctgtaattaaaaccatcaaaagatgccttggtcttcagtcagcattattgtgcccacattaaccttccccacaagcaaaaacactactttttcctctctgttttctacattcttcttcattaactccaaatcgagagtttcattatttttcaaatcagaaaggagggtttacaaaaggatctgcagatttgaaagatgctgacaagaaagcaaacatgaatggaaacactactttttaaaaatgtatttccttccaggaagagctgagcagtacaggcatgtggcagaataggaggtcatttcaaaatatatcatgttgagcttcactcccaattatgagcagcaattctgtttgataattacctgggcaatacggaaatggatcccatttacaagcaaacaaaaatgtgtttcactgcaatatgctccattctgaaaacgttcccccttttaccaacttaataatcataccattctctacataagatttctttttctcactcacctctcctctgtactgcttggattctctcccatctggccaatgagtctaaaatgcagggacttatatcttaatttcatttttcaaaataagacttcgctcatgcctgtaatgccagcactttgggaggccgaggtgggcggattacttgaggtcaggagttcaaaaccagcctgaccatcatggtgaaaccccatctctactaaaaacacaaaaactagccaggcgtggtggcgcaggcctgtaatcccagctacttgggaggctggggcaggacaatcgcttgaacctgagaggcggagattgcagtaagccgagattgcgccactgcactccagcctgggcaacagagcaggactccgcctcaaaaaaaaaaaaaaaaaagctcaaaagctcaaaaaggtcaaaacctcttaacatcataggaatagatgaatactttcttgacaatgttacatatgaatatacgtagaaacaatattgcctgtatataaaacaaaaacatatatattttctctgttaaattcttaaataaaacaaggccatcaactatcactatttctaactctgtttaatatgattttggaagcattattctaatcaagtagataggaagaaaaaattagaagtataacccttggtgatactaaaaattcattagaaaatgtataaataataagaaattgaaggtgcctaggtacaaaattaatattcaaaaatcaagtatttgtgtatacaaataacatctgcttagaatttataatgaaaggaaagatcccaattacaatagtaacaaaagataaagcacctaacagtaactgaaaaaatacatacaagagaattgtaaaatgctactaaaggtccacccctccaaaaaaaaaaaatatctttagcatatgaaaaatagtatgtgttcccagataggaaggatcaacatcataaagacattaatagttcctaaattaatctaaaatgtatgtcatcctcataaaatattaaatattatttggaactacacaaaattatcctaaaattcatttgaaaaataaatatgcaagaattgccaggagaattctggggggaagatagtgaaagaagtctattctactaaaatttagctaattaaaacagtgtggcactcattcataaagatgtcaacagaatagactagaaaatcaagaaaatttcttaattcatacaggagtttttttaagataaaggtggaattttaaatcagtgcagacaagatggatcactcaataaacagtgttagacaactgggtcttcatctcaggaaaaagttggatttgtattcttaaataataaaataaaatccaagtgcatcaaagatttaaatgtgaaaaattaaccataaaaatattagaagaaaacatggaaaattgtttttatgaatcttgtagtggggaaaaccctttctagtgtcccagacactgtgagtggtctgttcattataccagttgtccactttcctcttctttccagagaaacagaaccccaattctgttcagggtgagaataagcctaaccccaaaggatgggtcatactggctgtcatgttctccactttcccacactcccttgcagctacagtgtctgtgtggcttggtttgggtcaataagacataactggaaatctgatgggaaaatccttgctttctcaataaagatggatagacatgctggtgtcccatctcctttgaaaggttagttctgtagaaatcacctagggatcagataagagaggccaagagagtagaataaaagatattagccctgacattgttgaacagctgaaccagtgctatcaaccacctattcctggaattctcactatgaaattttaaaaataaaatcctatttacttaagccactgtgtttagagttttagtttcttgcagttgtgtgattcttggaatcctacctgacacaccatgaatgccataaaattcagaaaccctaaaggaaaagattgagcaatttgacaacatgaaaaattttttaattctttgaaaataaaaaggattccaaaaagaaaaaaaaaactaatataagatctttttcatttacattatagtccagagctaatatttttactatataaagagctcaccaaatataaagtaaaagaccacagtccagcaggaaaatgggcaagggatagaaacagtgttcatcaggaagtcctaacagagcaatcaggtaacagaaagatataaaaggcatccaaataggaaaagaagaagtcaatttatctctctttgctgatgatataactctatacctagaaaattctaaagactctgccaaaagactcctggaactgataaacgacttccgtaaagtttcaggatacaaaatcaatgcatgaaaatcagtagcatttttatacactaaaaacattttcgctgagagccaaatcaagaatgcaatcccatttacaatagccacacactcaaaaaaataaaatacctagggatacatttaaccaagaaggtgaaagatctctacaatgagaactacaaaacactgctgaaagaaatcatagatgacacaaacaaatggaacaatacatgctcatggattggaagaatcagtatcattaaaatagttatacttcccaaagcagtcttcaggttcaatgtcattcccaaactaccatgtcatttttttgtatatgtgctgccgaagcgagcataccaatgtcatttttcacagaattagaaaaactattctaaaattcatatggaacaaataaagagcctgagtagacaaagcaatcctaagaaaaaagaacaaagctggaggcaatcactttactaaacttcaaactatactataaggctacagtaaccaaaacagcatagtactggtacaaaaatagacatataggccaataaaaaagaataaaggatccagaaataaagctgcacacctgtagccatctgatttttgagaaagtcaacaaaaaataagcaatggggaaagggctccctgttcaataaatggtgctgggatagctggctagccatatgcagaagaatgaaactggacccttacctttcatcatatgcaaaaaattaactcaagatggattaactatttaaacttatgtgttcatcaaaaaagaaatgcagatggctgttcatcacatgaaaagattttcaacctcactcaaaataaataataaaataataacaaaataattaaaactataggaatatagcattcctataaatttgtctgatagagatttaaaacaaaatactgtatttgtggagaaacggatactctcaggcatttttgttagaagagaaaaccgaaataacttccatggagagcaacttgtcaatgtcaccaaaattacagatgccaccccagcaatcacaacctgtgtatacaattaaagggctgacaataatctaagtttctgtgaatatagggcttgttacttaaattataataataattatgcagctataaaaaatgaagaggttctatacgtatagatgaagaacaatcttcaagatacattgttaaataaaacaaaagtcaaagtccagaatgtgtttgtcatgcagccaattcttctaaaaatatattaaaagggagtgagcggagattgcgccactgcactccagcctgggcggcagagcaaggctccgtctcaaaaaaaaaaaaaaaaaaaaaaaaaaaaaaatatatatatatatatatatatatatatatatatatatatgtaaagggaaaatatgttattgtacatttataaacttccttaatagaacacacaagaagctggtaagggtggctgtctctgagaaggagaactgaagtgctggtgttcccattatctgtaactataatgaaccaccctgaagcttagtggcataaaaccacatacattttctcatgctcacagattctgtgggtcaggaatttggacaagacgcagcagggatggcttatctctgcccattgatgtctggagctccagctgagaggaagtgattggcagtgtgtgactccaatggcttgcggctggaaaaatctgaaggtttcctcactcgcacgtctgggctcgggctgcgataactcagctggcgtttttaaccaacgtgcctacatgcgacctcgacacggagcaggggcatcctcacagcatggcagcctcagagcagtcagaccccttccgtggtgggctctgagagcaagggttccaacgagaagggcagatcagcatctgccttttatggctagcctcagaagtcacagagcctcccttccagcctgctccgttggttgaagcagtcaccagcctgcccagattcaggaagcagggacatagaaattgaaggtcatcaacttgctaacagttgttatccctacagagtggaatctggggagattttcattttccccattggcctacatttattgcctaatttctctaaacgagcaagtacaaactgtgttataagtgttttggaaaaatcatagatcttgcttaagattctcttccgtgcaacacagcaaatctatgtttctcatgcattttccttgtgagttcgatacagcgacagagttcagaaatacactgtatattttccataaactctttctacacagcgatgcatgacctaagaggcatcaagattacctgtgactgcatgagtgaaaggacatctcatttatctgcagaatcagggtcttgcaggcccagaagcactgcttccattttcttcacttgggccttctccagcggtgcacagagctctgtgggacccacaccctgcgtccttgtccttgtcacatgagggtagtgcaagcccaagagaacgagtggccggcctgtctttgtccttgagcctggctgtcctgcctttactggaagcttctctttctctgtctcttttctcctccttctacttttattctttgctctctgctcaccccctttaccctctctacatttttcctctttccccaattttctctctagctctctgtactctctcctttcatttactccctgcaacaatcataccacctccctaagcacgatacaaaaacaggtgagggaaggactggatgaaattaacaaagcaggtttacatggctctgttgccttttctcagctaccagttttggttggttggtttttccatctcaatctgtttcattttatctgtctcatttccttcttttttcttgtaataaaatatacacagcatgaaataaatcattttaaccattttgaagttcaaaacatttgcacagttcagggcactaagtacattcacattgtacatcaccaccacccgtctccagaactcttcatcttccaaaacagaagctctgtgcccaatacataaccagcccctcactctccacacacccaccccatggcagccaccattctactttctgtgtccataaatttggctacattaggtacctcgtataagtggaatctcatgatatttgtccttttgtgactggcttctttcactaaaataatatccttcaagcccatccatgtgctaacatgtgtcagaattttcttcctttttagggctaaactttattatttatctattgtatggatgtaccacattttgtttatttactcttctgtcaatggatacttgggttctcaggtaccattttttctcaaacaaggtgacatgggctttttcccttccctcacctcaaagaaggggttccctccccctgctccttcatcccagcccacaggcaggtccgctctccactgcgggagctcctcagaattggggccagccaccctcccccgacctttgtccaccctcttcctgattaatggcatctatttctatggcctttggtaccctccagggctggtgatgccaggcttctctctccaaagacaacttctcagagtcccaaacctcacacccaaccaggtatttcattgcaccacttacgactatctcatcacatggtcaaacccagaaatcttgatttttcccacccatccacttgcagaataaatgtcatcagaacctttctgtaagtctgacaggagactagaggtttgatcttcagggaaattaaagcttgctgctccagctccagacaccacacatagagaaggatgagagggagactcagagctgaaaagagggtaattcatagaaagtctgtacactctatggtaggaagcatatccagcactgctaccagaaaaataggaccagtccccaggcaagaacccccaggcagtttcgtcactggagaaactgagggtgtccgcaaaagtgaccttcagacatggctgtgtggccacttttcctcttgagaagcctcctggtaaccagtggcaaggccgagccatgcctacaaagctttgagtcatgcagtagggcctcactcttacctgtaaataaacagccaaggatcaacaggcatttaaggaaaacagcaaggtaagcagattatttagaaactgagaaataaataccaagagcagagctaaaggagttgaagatatttgcctctgggcagcaaagttgttgaatgggaaagaactaatatgttcaattgtgcattttttagtgctgtttgatttttaaatatgtttgtgtatatatatacacatatataggtaaaaataattttttaagagacagggtcttgctctgtcacccaagttggagtgcaatagtgctattgtagctcactgtaacctcaaactcctgggctcaagcgattatcccacctcagcctctcaagtagctgagactacaggcacgtaccaccatacctggctaatttttttaaaaaaatttgtagagtttcagtctcactatgttgctaactcctggctttaagagatcttcctatctcagcctcccaaaatgctgggattacaagcaagagccactggacctggccaggtaaatataattttaaaaaaagaaaatatgagtaccgccaacaacctatctgctcaagaatggagaaatctggaaattctctctgattcttcctttttttcccatcctacaaaactagtctatcactaagattcacccatttaacatccaaaatatttcttgattcatccacttctttccgtctttgccaccaccgtcctcaaatatgccaccagcacctcttcctggttatacacagccccgtattggtctctttccttccaaccttaccccttctcaaggtaatacacttattcttctcaaggcaataaaactgatcagcataaaaggtaaatcaggctgggcacagtggctcattcccataatccaacatttggggaagctgaagtgggaggatcacttgagcccaggagtttgagagcagcctgggcaacctagtgagaccccacctctaaaacagaagaagaagaaaggtaaatgagatcatgtaaaaccctaaaatgtctatcaccctcaaactgcaacataaactccaatagttacccctaaggtcctgctggatctgacccccacctacctgttcaatcccagcttgatttgctccactctcttccttgctcattaagctccagcctcattattttgctttcctccaattccaaaaaaaaaaaaaaaagccaagatctttgctgcttcgggcctttacctatgtcatctacatgcatggagatgtggttgcctttctcctcatccaacaggtcccatcccatccgagtctcaacagaaacatcacctccccagggagaccgtctccaccaacctatcaaaagtaagtcactcctgtgatcgcctatttcatcttacttgcttccttcatatcatttttcattgtattatctattcatttgctttatttttctgctcctccagcagaaaattagcaccataaaggcaaggaccatgccctatctctagtatctggcacagcacctgtttgaataaattactttctacagtgaatgcaaatatcatttgcatctctccaggcagttttccaggttgtactattcttcggaataagcacaacaaacttgcttaaggattaaagatgtctgacaacagttgcttcttagtgtgtgacacagcatcagccactctccaaactgctaagacgtctcccttgtggggctcatgcaacagtttatctatttatattggagggagtagagaataggaaaagtacacagacaaattgattcgggggtggggaagaatgctgtttttaaaaagtgatcaatacatcttccttagatagtagggaggaacccctatcttgacaggctttggggagatagggtcaaatgccaatttctacttgaatcacagcagtatgggtgccgtaacagcctagcatttcatcattatgatgactattaaaatggtaataatgcaagagagcagggaaccagacgatgaaaagggataggcagctaaatacctcactgtgttcttcagacattttagtcatagctacaccataatcattaaaaagatctgcaggatgttagagtaatgctggtgatggggcatttgcactttctttgacctgaaaagaactatctattttgttaccttaaactttaatccctgtcacttcttctttctttcttttttttttttgagacgtagtttcgctcttgttgcccaggctggagtgcaatggcacaatctaggctcactgcaacctctgcctcccgggttcaagcaattctcctatctcagcctcccaagtagctgggatcacagatgcatgccaccaggcccggctaatttttatatttttagtagagacgggatttcatcatataggtcaggctggtctcaaactcctgacctcagatgatccacccgcatcggcctcccaaagtgctgggattacaggcataagccaccatgcccagccatccctgtcacttctataacccatcttgtccaaaatcatgatgacttatcttaaggactattggacacacatttgaaaggaaaggtgtccactgagatgatgttgagatcggaaatcatacagtcctctcttccctcccacttataatggaacagaaacccaagtccttccttgaggagaaggaggaaccaaatgattcctcaacatcctttccagctgtaagattcaataactggatgatccatcatttcctgaaggaacttagcctaggagattggatggtagtaaactgtggaaatgtcataagcctcatcatacctgctaagcagtcaaagctatacatgagcatcctacaaaaagaaaagcccagaagagagaaagagaaaatataaaattttatatcagcaaacaccaggaggatgaaatcacactcattatttgctcattaagcaaatattcttttagcactcactatgtaactggcacagtgcttgaaactggaggcagatatgtaaaataaggccctgggctcaaagagtagtggagatggccttcaaaataaataattatgcacagtctcatgaatgctgttgtgagagtcagtactgcaaagttctgtaggaatccagaaaggtaagtagctctactgagagaataaagaaaaactttatcaaagagatgacatttgagttgaactttgaagtatggataggagtttcctggtaatttaggagaagggattgcaagaagaaggaatggcatacataaaggcttaaagacatatttggagtgagaggaccaaggctgagtttccctgtctgccctggtatcaaggcagacaaggaactgatttaaagtgtactgtacgccttgctgaaaccttagatttttttcctgtaaacaatggacataattgaatgacttttactaagtgtacttcatgatcagatttcttttgttaaaaaagaattctctagtagaattgccgaaaattaggaagggataaagtcaaggaaaccagtcacgaggctactattaataatccagccaagaaatgagggtgcgccttagcatataaaaagatgttcaacttcagtataatgagagaaattcaagctaaatccacactgagatacaatttctcacctatcaagatagtaaaaattcaaattcttgagaacacatgcagttggtgaggatttagataacaggctttcttatatattgctggttggagtacaaaatagtacaactcatatgggctgggcgcagtggctcacgcctgtaatctcagcactttgggaggctgaggtgggtggattgtttgaggtcaggagtttgagaccagcctgaccaacatggtgaaaccccgtctctactaaaaatacaaaaattatctgggcgtggtggcaggcccctgtaatcccagctacttgggaggctgaggcacgagaatcacttgaactcaggaggtggaagttgcagtgagctgaggtcacatcactccactccagcctgggcaacaaagcgagactctgtctcaaaaaaaaaaaaaaaaaaaaatagtagaactcatacagaggagaatttggcaatttcctgtgaaacaatgtatgcccataccctttgatctaactatcagatttttaggaatttaccctgaagatacttctacaaataccaaacaatgtatgtataagattatccaactgcagcattatttgtattaacaaaataatggaaatactgccaaatgcctattcaaaggagtctgattgaatagatgatggtagagtcacacaatagaatattatgcagctatgaaaaagaatgtgaaaaatctctataaattaatattaaatgatttccaggatatactattgaatgaataaagcaagatgcagaagataatatagaatataccaacttttgtttaggaatgaaaaggaaattaaaaatgtgaccacacatatttgcttatttttttaaaaaaagaaaagaaacacaggaaatacatttcagaaataagtgaaaaattgttaccaagaaaggatgggtgaaaatgagacagaagggataaggataagagcaatggggatatagttttttaagcaaagcctaatgttgaacacaaatataaaaagttaattgaacttagagataaggtaagcatgtcccctctctcatcactgctttcaacattgtaccgaaagtcctagctaatgaaataagacaaaaaaagtaagtaaaatgtatagattgagagggaagaaatgaaactgtcttggttcccagatgacatgatcatctatgcagaaaatctgaaagagcaataataacaacaacaaaaactcctggaactaataagcaattatagcacgtttgcacaaaacaagggtaatatacaaatgtcaatagctttcctacacaccaacaataaacaagtgaaattagaaattaaaaacacattaccatttacatttacattagcatccaaaaatgtgaaacaggtataaatctaacaaaatatgtaaagatctatatgaggaaaactacaaaatgcaggaaaaatataaaagaagaactaaataaaaggatagatatttcatgttgatgaacaggaacactcaatattgtaaaggtatcagttcttccaaatttgacctacgaagtcagtgctatcccaaacaaaatcccagtaagttattttgtagggattgacaaactgattctaaagtttacatagagaggcaaaaatcccagaataatcaataatacaatactgaaggaggaaaacaaagccagaggcctgccgctgtctgactttgagacttactctgaagctacaggaatcaagacagtgtggtattgtgaaagaatacacaagtggatgaatagaacagaatagagaccccagaaacagacatatagagagacattttttacaaaggagcaatgataatatgatacagcaaagatagtcttttcaacaaatggtgctgggacaactgaatatccacatgccaaaaaaaaaaaaaaaatctagacacagactctgtaccctttgcaaaaattaactcaaaatggatcatggaccaaaatgtaaaacacaaaactataaaattcttggaagataacgtaggagaaaacctaaataaccttgagtatgtcaacacctttttatacacgtcacccaatgcacaatccatgagagaattcatcaataagctggacttttctgctctgtgaaggacaatgtcaagacaatcagaagacaagctatagactcagagaatatatttgcaaaggagacgtctgataaaggactgttatctaaatacaccgaaaaacctcttaaaattcaacaacatgatttttaaaatgggcaaagtggaagggggaaatgaagagaggtgggtgattgggtagaaatttacagttagatcaaaaaataagttctttttttttattatactttaagatttagggtacatgtgcacattgtgcaggttagttacatatgtatacatgtgccatgctggtgcactgcacccactacctcgtcatctagcattaggtatacctcccaatgctatccctccctcctccccccaccccaccacagtccccagagtgtgatattccccttcctgtgtccatgtgatctcattgttcaattcccacctatgagtgagaatatgccgtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcaacatgatttatagtcctttgggtatatacccagtaatgggattgctaggtcaaatggtatttctagttctagatccctgaggaatcgccacactgacttccacaatggttgaactagtttacagtcccaccaacagtgtacaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttggctgcataaatgtcttcttttgagaagtgtctgttcatgtccttcgtccacttgttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacgtttaagtctttaatccatcttgaattgatttttgtataaggtgtaaggaagggaaccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggcaccagtaccatgctgttttggttactgtagccttgtagtatagttagaagtcaggtagcatgatgcctccagctttgttcttttggcttaggattgccttggcgatgcgggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgtttttttttgaaaggatcaacaaaattgatagaccgctagcaagactaataaagaaaaaaagagagaagaatcaaatagacacaataaaaaatgataaagaggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaataatttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagcgctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaaaaataagttctaatgtttgacagcacactggggcgactgtagttagcaaagatatgttaaattgctgctatgtagaagagaggacttgaaatgttcccaacacacagaaatgataaacacccaagacgatggatactcgaaacaccttgacttgatcattccacattctgtgcatgtaaaaaacattcacaggtaccccatcgatatgtaaaaacattatttatcaatagaagaaaaaattaatgagacagttttcaccatattgtaccctctaaattattaataacatttttgtgagagcaaaaagtatttgctatcatttaataatgtagttttaaaatataatttcatcttcatcccaaacttttcaattttttatttctgcatgttttatataataaataatgtattagtagagtaatatattaaaatcttcacaagtaaataaatatgtatatatctaaaaactgggcaaaagacttaaatgatacctcaccaaagaagatatgcagatggaaaataaaaatatgaagagatattccacatcatttatcattagggaatcgcaaattaaaacaacaataagatagcactacacccccattaaaggagtcaaaattcaaaacaccgaaaacaccaaatgctggcaaagatgtagagcaacaggaactctcattcattgctgctaaaattgcaaagtggtatagccactttggaagatagtttgatggtttcacatacaactaaacatactctcaccatatgatcgagcaagtgtgctccttggtatttatccaaatagattaaaaacttatgcctacacaaaaacctgcgcatggatatatattgctataaacttatgaagtttaaaattaaatttgaaattgctttattcataattgccaaaacttggaagcaacaaagatgtccttcactagatgaatatataagtaaactgatgcatccagacaatagaatattattcagccctaaaaagaaatgaactatcaagccaataaaagacatggaggaaacttaaatgcattttactaagtaagaaataccaattggaaaaagctacagattacatgatttcaactatatgacattctgggaaaggcaaaactatagagccaataaaaagatcagtggttgtcaaaactatagagacaataaaaacatcagtggttgtcaagggttagggttaaataggcagagcacagatttctagggcagtgaaactattctgtatgatcccataatagtgaatatgtatcattatacatttgtcaaaactcatagaatgtacatcaccaacagtgaacccttatgtaaactctagaccttggatgataatgatgtgtccacgtagattgatggattataacaaacgtaccactctggtgctggctggtgattgtgaaggaaattgtacactgtgtgtgaaaaaaagtatatagaaaccttctgtgcccttcatttacttttgctgtgaatctaaaacttctctaaaaaatcaagtttattaattttttaaactaacctaactttatctgaattcaatagcatatccacataggaaaaccaagtaattttcaaagaccatattctatatatcactagtaggacatatattctatggacaaactgcaaataaatataaattttacttagtagtgtattagtagtagtaataatggtattatattctgaaactattttatatatattgtaacataaaacaaataagtaaaacaattaatattattggagccaagattttcactgtgaaagaaaaaataaaaatttaaaattttttaaaggccaagaataaatctgaattataattatcggtatgaattcatgatttgtaaaaatatattttttatcactttcattgaaagggcttaggtgtaatgacacaccaatagcaatgagcacatccaacaaccagatgttggtttctaaacatcattctccactaaaaagaacaagggctccaggtctaggactggagtgcaagttgagcctgggatctcttccctccctctccaaaataaagaaggacacagagtccaagggtcacggtaaaggttcacaggccctggcttgaagggtcagtccgggcaatttataaacattgattcagcgaggatcatgagaaaatgctgaagccactgggtaactttgttgggcatcaggattttcatacaacctgaaactattactcaaggattgcatactaactacgaagggagaaattacttttacaattgagagatataattgatattttcctttctctcttccaggcttttcttttcctaggctgctaactaagctgctatctgtggtaactttacactgtgtcagtctaactaagcaggaaccatgcctcccaaaattcactcccctgcatgtcccagagtagagctggtcaaattaggcatttgtgagcgatctggaaggtggacatgaaacagcatggtcaatgaagtaacgttttctggggcttaaattccactgagttaagggtcattccagtcatctgctcttccatctagttcctactgcttccatttctaggaagtgagatcaaagttctggcttagggaatagaagtacaggattagttttcttatttccccccttaacttccctcatcataccataacttgtcctggaagccatgaagagaaaaataacacctcttatttaaaccccaacccaacccacatgtgggatccaggaattacttaaaggccttatgtgcttggtcaaaaataaagaagcccatttaaatatttgtgacatcagtggagcagacactgatctgacagatggacaagactgtaaactgctatgtcccccaaagttcatgtgttgaaattaattgccatcattacagtatgaagaggtgaggcctttaagaagtgattaggccatgagagctccatcctcatgaatggattaatgcccttatcccaggagcagttagtcatcacaggagctgagtcctgataaaaaccacaggtgtggtctgatttcctctcttcatctcctgcaattgcttctgccttctgcccttccaccatgggacaaccctcaccagatgccagtgctgtgctcttggacaccccagcttccagaactgtgagaaagaagtttcttttctttataaattacccattctgtggtattctgttatagcaacagaaaacagactaagccagtggcatttttagtataatatgccctataagcttagcagaaaaatcactcggcccaccatgttagtgactcatgggtgttaatagtgacaattcaaaactctactggggatacagccaatttctgcttatccacaaatagatgattactttgccaagtatttgcacagcaatctgttccagcttgggctaccacagtaggccccagcttgggtggggtcagccctgtataaaggaatgtggagaggccaggcatggtagctcatgcctgtaaacccagcactttgggaggtggaggcaggtggatcacttgagttcaggagttcaagaccagcctggacaacatggcaaaaccctgtctctacaaaaaatacaaaaattagccagccatggcggcatgtgcctgtagtcccagctgctcgaggggctgagatgagaggattgcttgagcccaggaggaggagatggcactgagtggagattgcaccactgcattccactctgggcagcagaaccagaccctgtctttaaaaaaaaaaaaaaaaaaaaaaaaaggatgtggagtgcaggggtggtggtgattgggagtagaatatagagtgacgattaagggggtattattttcatcccagcataggcctgattatattctaaggtgaaatgttattcatctgtgccactccatatttactgagcatctactgtgattgcaacactgtgtaagccagtagggattcaaaagctataaaatagaatcccaacttcagaaaccttaacttgggtttaagacgcaaaccatagacacaaaaattattgcatcaatacccacctgcaatgataaatgcctgagcgtgctgaacagacaggagagagtttggaagagaaattatccaccatgtaatgcaataggcaaatcacaggactgacggaattctctagaaagaaatgagaaagcagtaggagcaaggaacatagttattaagcatctattaatgatgctactaacaactaccatttggaggcatttactgaatgccgagtgctttacctgtgatttctcattgaagttttgcaaccatcatgtgataaaatgaattattaatctcatattttaaattaacaaagtgaggtttcagataagtaattaccccaagtcacacaatctgtaaataactaagcacaactcataaacaggtttttccgactcagagttgatgttctttctatgtctaggcctgggctctttgctttgtttcctttctcactagaaatgcgtcatatgtgccatgtgtaacccccatggcctctgccttcaaggagcaagtcatgtacgcaagacggtggtgggggacaagaaaatgttgagccaggctgggtgcggtggctcacgcctgtaatcccagcactttgggaggccgaggcgggtggatcacgaggtcaggagatcgagatcatcccggctaacacggtgaaacctcatctctactaaaaatacaaaaaaataaaattagccgggcatggtggcaggcgcctgtagtcccagctactcgggaggctgaggcaggaagaatggcgtgaacccaggaggcggagcgtgcagtgagccgagattgcgccactgcactctagcctggatgacagagcaagactccgtctcaaaaaaaaaaaaaaatgttaagccaaagggtgattgaaagcccagatgtatggtagaggcaaatcatgctgcaggggacgtggtttgcagggatgtctctcaggaaggggttgtgccttaggaagaggccaccattctgaaagcatcacatccctctagctacctccatggaattctaccagtgctcccaggacaaattctggatacaaaaattgcaaactgcaacagcagcccctcaggaggtctttttacctgatgctacgcaacagggcatgctaattatacttaaatagcagaaaaatggctcctaggtggctggatggggtagattacggacataagaggccactagcattcattcccaagcccagtcagcctatctgagtaacggtggtgctcctggggcagagtgtattaccccccgcctgcaatgtgcctaactagtgtcaatattgacagaggagctcatgggagaacagatggatggagtgaaccaaaagacagccacttctcagtcttcattgtgcaggaggagtgatccgggcgaagtcgtgctccactgtcaccttagcaaaccttatcgcctcctcataaacatccaggtaactcccagcaaaaggtgaataagaaatggcaagggttcagtgaagcgtttgtatttctgtctcagcaaaaaacaaatcctctccccatcacttgactgtaattttcttctgtgtaattttctagcaatagttggcaggtttgggaatcactagcacatagtcattagctgtaaaaacgacagttgatgattctgggagtccagagagaagagaactggccaagaaaaaccctggggaatgccaacatctaaggctgtggtgtgaagaaaggaagcccacggatgaggtagcttttcaatgatcgcagatgtacatgaagaggaagaactaggactgaggggtatctcaggagccccaaagtgtcaaaggcagcagaaaaatccaggaagaagagagctaaaaaatatcccctgggtttggtacataggtcatgaatgacattctcatgagagctttggtagaatgatggggttcagaagacagccccacatggaataaggagcaaaagggaggtgaggaagcagaggggaaggagaagagttttcagagatgtttgaataagaaattggagggttgctggcagggaagagtcaggggataattttttttttttttttttgagatagggtctcactttgttgcccaggctggagtgcagtggcacaatcctgactcgctgtagcctctatctccccaggctcaattgatcctcccacctcagcctcccgagtagctgggactacaggtatgcactactacgactggctaatttttgtattttttgcagagctggagttttgccatgtctcccaggctagtctggaactcctgggctcaagcgatccaacgagctcggcctcccaaagtgctgagattacagtcagatgacacctcacatggccgagaataatttattgaggatggtaattatttgagcatgatgagaggctcaacattgagaaatcctaatggaagtgaaggcactgatggaagaacattggtagacattagagggagagcctggaatatgagcccctcaatcaaactcccaaagttttcttgaaaatctgtaaaccactgaaatcattctttgatatccttttttaacctactcaaggacaggaggcccagactggccgtctttgctagctgccactaaacagtttacctgccaccccctacccacccccagagagcatagataagatttattgtgtatacactgcagtttttcctcaacctccacttatttttataaatccttaactaggcttcagagctgattccctcacatatgaggaaacaatttgcatacaaaataattaaccaacatgcaaactaactagatgtttttcagttattttttgacgagagaaaaaatcgcagaagatgcatgagcaaatggcaatgccggacataggatccaaacaggttgggagatgacagcaccagaggcagcatgatgaggttgcctttaagtaggagagggggcgctctgggctctgaccctggaggaagtgcacaaaggatgcatattgattggcaggggaaatgggtgagggggttccaggggcatggggtgagcagagcagggagtcaaagggctgtctgctcagagtgcagaaggccatgtatggggaatggcaaaggtttctaagttgttgaagagaataggaaagggatgtagcaagaagataaaaggttgctggtactgggcatcgaaagacccagttgaggctgagacacaaatggtggcagtgtgcatggcctttcccccaaaacactgctcagctgaccaggtgtgaaaggataggagagtagggggaggtgttttgctgagtgggtacagaggaaggatgggtgcggggaggcaaagatatcaagggtgttgaggggagagtagctcagatgatcacaggacttggactgggaagggaagggagggaggcgaggagggtgcttctgttagccagcgttctcgttagagggagcaggatccgctccagctagtttagcagaaagtgatatagatagctcaaaaaaatccctgagaggtgcaaagaaacagactcttggctgagcttccaggaatgactccccaccacacacggtggagccggcccatcaaaggagctgagcctccgccatcatcacgaagctttcacttggggaccggccaccacagctgcccgcgagagaaccaaacccccaatgccaccaccatcctcctggaaaacagaggcctctgctctgccttccctggagaactcggttttgagtcaaagcctgacgtagaagcattatggttggtgacacctaaatcacacatctgcccctggcagcaagggggcaagggggacctgcgtgtgtgtgtgtgtgtgtgtgtgtttcatctcccttcccccttgcacccctgttgagaggttggtatttacactatgaaaaaccatcaaagtgtggaaagagttcaggaggttttgggcagccagtcactatagcacgggtccccaatccctgggctgtggactggtaccagaccatggcctgttaggaaccaggctgcacagcaggaggtgagtggcaggtgagtaagcattaccacctgagctctgcctcctgtcagatcagcggggggcatcagattctcataggagcatgaaccttattgtgaactgcacatgtgagggatctaggctgtgagctccttaggagaagctaatgcctgatgatctgaggtggaacagtttcatcccgaagtcatgccccttccacctgccattggttcatggaaaaattatcttccaggaaaccagtttctggtgcctggttggggcccactgcactatgggggatagcaaggctgctgcttgggtacgtgctgcttctctgttaaaatatcctgctaggcatatgcaatcctgcaggcacatgacttggcaaggtctgttctttatacgaagagaaacatgctccttctttgggggacattaccctgccccagtgcacagcttgctgagcaaagtgcagcttagatttcagcccctccctgactcctcaactggcaccaccatttgtgacaactccagagctgactgcctgggaggaaacagaaggaaccagggcctctcggcctctcggagtctcttcaaagtcaaacagcttgtgtggtgggaacaagatgacggggagtcagaaggatgggtgctgtggtcacagcatgaagcacggggtgtaagacttctggggggatcctcagcgtgggatagcaagtcctgtgggagggtggagtgcagtggtgataagatcttgaaactgaggaagcagtttgagaggcagatcatctataggggtattaaaaattgagtggaagaaaatgaagaatgaagcctcagtgagagaatcacaaggaaacagtaggtgacaatgagaggaggtagagccaggtggtaatagcctcggacgacttcacacaggggcagagtagccatgggagcaaacaagcgacaaccacaacagtctagctttcctctcctggccccttgctacctggaacatcaatttgttcatttaagcaaatatttatttatttaaaccaataatgaacctccatgtcttagttggctcaggctgccagaacgaaataccatggcttaaacaataggaatttatttttcatagttcttgtaagagtccattctcgcactgctttaaaggaatacctgagactgggtaatttataaaggaaagaggtttaattggctcacagttctgcaggctgtacaggaagcatagcggcttctgcttctggggaggctttaggaagcttccaaccatgctggaaggcaaagcaggagcgacaggtcccacatggagggagcaggagcaagagagagagggaggaggaggtgctgcacacttttaaacaaccagatctgacgagaactccctcactatcccaaagagagtaccaagtggggggggtggtggtgttaaaccattcatgagaacccgcccctatgatctagtcacctcccaccaggcccacctccaacactgggaattgcaattctacatgagatttgggtggggagacagacccaaaccatatcagttctggagtctggaagtcggagatcagggtgtcagccagcatggctggggtctggtgatggccaccttctcactgtgtcctcgcctgaggtcggggcagagagagagagcacatatgagctctctggtgtctcttcttataaggacactaatcccaccatgagggtcctactcttacgacctcatctgaacctaatcacctcctaaagaccccctctccaaacaccatcacattgggcaacccaacttgttatctccagcctgagcctccccccagaactcttggacccctgtgcttcatgctgtgaccacagctcccatccttctgactccccgtcatctcgttcccaccacaaatattctttgactttgaagagacaccgagaggccaagaggccctgggtgcctctgtttcttcccaggcagtcagctctggaattgtcagaaatggtggtgccagctgaggagctcctcagtgggcttcaatgcatgattggggaggggagggacacaactcagtccacagcactccactatctgtgaacaaaaacaaagtctctattctcatgaagcttacttagcttctactagagggaggtggacaataaacaaaaaataaataaatgatatattgaggtaacaaggccataaaaagattaggttggtggggtgaggagcggctgggcattactctgtatagaatgaacatggaagatgaaggagtaagacagtgaatatctgtgtgaagagttttcaagtctgagagcagcaagtgcaaacaccctgaggcaggatcaggttttacctgtggagctgccgaagagagagggaggaggaggaaagtagaatttgtattcgttggagtgtaactggggggccaaccacgtaggcgcattgtaaagacttcagcttttacagctgaaggtggaaagccatggcaggttaaaggggagggaggtgacatgaccgagaaagggaggatgggaaccctgaggtgagaaagtgacacgggggtgctcctcgggagaaaggtgtgttgcagaaaggacaaggaggtggcagcagagtggtttggataggctgagtgtagtggtgtgagggtcccacaggcacagacccctggggtctgcagcagccagaaggggctgccctgtgggagacccattctggggaagggctgaggttccatgtggaagccgccggcagcaagttccacaaggtctcaggatggaagatgagaggggatatggcaaagcctgggtgcctcttagaatgtgcagaaaggctttctggagagtaggcagagggcatgagtctctctggccaagagctgcctcctgctacgttttgagaggaaaaggtagcacagtggaaactaggaaagctgtccagccaggaaaagcccccatccctgagatctgggtcagcctaaaggttctgatgctttggtgagccggaggaggagcttcacaaggaagagtcactggaaggagaaaccagaagcagggagggaagggctgccacctgaggagacgtcctccttcacgactttgctggcctggtcacctgggcctgcaggggaagggcagggaggtgccacctattgtgaaggaaaatcagccacagtgtatgtctaagcaaaagccactctccaaaccctcgtttgcaattttgtcacttctttggcaacaagccccctgcagctgttccacccagagcctctgccaggtgacctggccgtgcccagtgccccacagctgcagcctgctggcggggactccaagtctcccctgctcccagctttcctgactcggggctgttgggcttggagggagctgcattgggggacaggtgagggaggaggccggggcaccagcaggaagctctggctctccttctctttcctggtaaaagcaaggcacaaagcactctttgatctgtgccctctgccagttctggcagggctgcgcttgtcactgttccaaaaaagagcagaaggttacttagctatggatgaataataattgggcatttgtctaacagctactgtactgatgaataattaaaatttttattacaattgaggcaaagagcactctacccatacggatggtctgtcagctctgccagaggaaatgcaggtaattgaagagtgtcctccaagttctgaaataatagtcatgatcatggcaaagatgtctgggttaaaagctgggaaaataggtggacaaccagacccaatcaccaaggcttcttcctttttgggatgtaataaggtaaatcggctaaagctggtcttgggagtgcaaatggctggaacagtcagggaaagctaggagtgaaaaccaggaggaacagaaataaagagaaatagatgaagacttactaggcaaatgcccttatatagtagctgatgaggatgactttgatgagataagaggggacagctggagcataatggaaaaagtcagaaatgagaacacccttgtcaaatggcttggctcctttttggctgtaatcttgtgcaaactcacttaacctgcacaagcttccctttctgcctctataaaatggggatgatactgtttaatcattggctcatcttctgaggattaaacaagataatgttgagaatatttaataattatgaaggcagacagcaaatgcaagtaattataactcagaagtcagaattaaaggtaactgggttcaaacagcttaagagttgggacgggttgagtgaatgaggatacagaaacagtggagaagaaaatcagtggtgttggggttggaccaaatgaaatcaacagtggaatttcactaacttaaatacattgtgcaaggtaaacaaattcctttagttatcaaataccatttgatacttcccgggtgtgttaataagacagtccactcaaaaaatggaccactaaatgataattattttgatgggagagtgtctatggaattcatacacccacgaaattatactgtgaggtgtgaccatgcacaggaaagactattatgcccaaccttttgagagcatgtcatgtgcaagagaacctggacacacccgagagataaatggcaagaatgccctggctccccaaacatataaggaggaggctgtggcttgctcttcccctgctcttcctctgtagtgatcggccatgcagtccatgtgattcgagtttatgatgggaaccaaaaatcttcaatgtaaaacattttttatttgttacttccatccatttttcctgctgtccttaaccctgctttttctcttttttccatcttaccttccttgtaattgattggggttagcatcctcctttttactgcctttattttgaacaactgataccatatttctatttcatagtgattcactttaaattgttgttatttaaatttaacctttaatattattattaaaagttaataatattaaagtaccttgagctaagcactcaaggtacataatcttttttaatccatacaacactcctgtgttcctcattttacacagaataaaaataaggttcaggccaggcacggtggctcatatttataatctcagtgtttttggaagacctaggtgggaggatcacttaaggccaggagttcaaggctagcctgggtaacatagcatgaatccatctctaaaaatatttcaaaattagccaggcgtggtgttgtgcacctgtagtccctgctactcgggagactgaggcaggaggatcattgagcccaggaggtcaaggccactgcaatccagcctcagtgacagagcaaaaccccgtctcaaaaaaaaaaaaaaaaagaaagaaaagagaaactgaggttcagagggatttaagtaactagctcaaggtcccaagacttctaatgcatagagccaggatctgaagcttatttatctcttaagaacaatcaaattcactataataattccttccaggccagacgcggtggctcatgcctgtaatcccagcactttgggaggccaaggtggacggatcacctggggtcaggagtttgagaccagcctggctaacatggtgaaaacctgcctctactaaaaatacaaaattaactgggtgtggtggtgggcacctgtaatcccagctacttgggaggctgaggcaggagaatcacttgaacctgggaggcagaggttgcagtgagccgagatcatgccactgcactccagcctaaacaacagagtgagactctgtctcaaaaaacgaaacaaaacaaaaatccctccatagttcatatggcaggtgcagcattgaccacagtgcagtccatttgccttacaatctactaggagaaataatagcacaacaaattaattcagcaagtatttgttgagtgcatttgttcaaggtatggagaaaccaggtgtaaatgagagatgaagccgcgttcctgggagtgactatgaggtgagcatcacgtgtgtggtgcccagcgctggaggccttgcagggccaatcacgacctctcgggatgtccagagatgctgctaccacccaagcagcccctcccagactggagtgtccaaaaacaagtgaacagcaggcaggctggcatggaaatggacagatgggacttgaaggcaggaacctgggtccagtcctggtctcaccatcactaggcccacgacctctgtaagaccctcgcctgctcagtcagtttcatcgtttgtaaataagaatactgttgagcagagaggtgcaggtgagagattgtccaaaaatgctttgaaaaggatgctaagtaacagttagcttttattatccctatgtttctgctaatcaaacccaggatagttttctacagcaatctgtgagaggctccattatatactgtatttgaatattccaaactactcctttgcaggaaggagtaattctctcacatgctcctgccttgagtgctgagtggagttacagaaggtgaagggccacagaggagaatggctgccaggcatctttccataccagctccttctttccattccttcttgggcatggatttatatagcacattaacaaagagccagggaggaaaggaagaatttctaaaccctttgctagaaatcctcaagtgtttagctacactggagctaccccaggtgctgctaccccaggtcctctctgtgaccctgccccgtctctgctggctgaacaccatatctgaatgactgtgccctgactactgagctccaagggtctggaatgccacttcacatcacaggataacaaggcagcagctgtccacccctctgagcacgcctggacatctggctggtgtctttccaaaggtctccatcctgagcagtcctcaagcaaacactcgaacctcctgtggtgaactcaggccaagactatgtgcttgactgtcggtggcagctgctgagctccagatgacacgggtcatgaagagttgggcttttatctcagttcttcaaacaaccagatcagacgtaacaggtaagcaatcggatttatttgcccagctctaaactcttgtgcctatcagaaagaatcaagccaaaccctgaaaggtcaatttcagatgctgtgtcattatcctcaccgagactttttccttctttctcagttttctcaagttgtttagaggagaactgcagggaattttcccacaatatccaggaacgaacacccagtaacatctccctgaatctgcagtgttatcctaaaattcaagtacatttgtagccgatccgtctgcatctgcacaatatccctaagtatcatggtggggagactgggatattcgtagtctgtaccctcagggagaaggctctcctatcttggtgcctatagaatggcagggagaggagataatgctatgaaaacagtaggaagagcccctgccattcaaagaatcagtctacccttgaaattagacctcatgcaacctcccttcctgatgcaaacctgaaaccacccatggcctcatggacaggaagccacccagcttgatctgtacaaacgtccttagagttggctgcatgaggctgcccctggctctgacacacactcaattatttgggaaaaaaaaaaaactgccttatactgaaatgaaaccagcttctttagcacttccttccattgatccatcagctataatgcacttgcattctatcttcaaaaaatatgggcagccaaaataaaaggaacgggtgtctgctctatctcttctagaccttcctctctgagaggtcctttagcttgttttgtgacactttttaaagtaagacatttagactcatatcttgacaaattataaatggctttctccagttgccccttttcctgccccactcctctgtccttccttacagcataagaccttctagtcattgcagttttcaacataaacagatagcagagaacacccggcaaagaccaacataagtggctgtgcacatcaagaaaaagacagttatgcctgcttctcagtgattattaagggaaaataaaacctacaatgataaacttcacattttgctaatttccagtcatgtgtctccatccaggcattgcccacaaccttaacttctctccaaaagtatctgagccaatgtgtcaacattgctccaaatacaaggtgcaagtatacactactgacatgaaccatcatccaaaacttacctatcttcctctcacagtcacccccacctgccagaacactccctggtggtgggaagagaggtggcaaaaagcagggcattaactaattaacacgtcctttcactcaacacgcttgccttgaagcaattttgttttcacagcatcgggctggaaaaaaaagaccttgaaaaatcatagccaatgcctcatacgttctggtagatctatatttgaaatctccaaagcagtagagaatttttttatggttgatgttgatgatgatgatggtgacatttttgtgtgttgtttgttttacattataagtatttcaacgtaaagagagaagcgtaggcaataataaatatctatgtagccacaatctagctaacacaataatttaccatattttgttccaatttttttgtaaaaaaacaaacaaacaaacaaaaaacaaaaagcattgagatgcatgtacttctgttggagcatccctccctgatcccagtcacttccctccactccagcaggcagccactggcctgaggctaatggtaaccatgccatgaagatctttaaaagatactcactacatatgtacgcataaagaaatggaatttttctttctacataaattctatcatattgtatgttctaatctgcacttgctcttttcacttgacatcctccttttcgatagagccataatgacccatgctgcctaactcatacatcccaatggctagtatttctcccatcttaaaaacaaaaaccttccatgaactttgccaaccatgtactgcccccctctctgttgtactcttcacctttcttgcaatacaactccctgcaagtgttgtccacactcccgatctcctagttttctcccaaactctctcaactcactccagttagacttcactagcaagaaacttgggtatcgtagctaaaaatccttccagcctagaattaggactttgcttcatgagtggccaagagaagcgtcatgtctcagttcccggtggtggtttctgtgtgccctggtagcttgacagcaccttcctcagtttgtctgtcctccacgttagcacatgggaccaagcacctggtgaactggcccaccttggaagctgctggcaattctgctgcctctgccaccacgagactctgaagaatactgtacatacacagatgccccgtctagaagtcctttctgacaagtcctaaggacatgcatgaacatcacattgagcctttccttcccttgcgaacaccatcatgtgggagaaggggaagagccactatccaggtctccccacctgtggatcactctcagcatccactcatctcaccagctgctaggctgacagagatccacagtgtggccaagaagagcttttcactccatccgctccgcccctaaaaacacacctctgttggagttactgtaagggtctgtgaatgaatgtttagatccccattagggaaagagatcagggctcagggatcaaggatacgtggttctcagagctcatcacctgcgagaggatacctttattgttcatccatatgctgatcccagccttgctccctgccccactcatacgaaaagcctaactatagctaactctatttataaatcccatgaatacacaagtcaggcttacggtggttttgtaaaccatttctctccttttatttttatttttttgtcctattcaattactttgcatctcagttgatgccaaaatatcagtggatatgcacacattctaaaaacttcagtgtactgctcagaaaatatggaaaaacagacactctgaatatcctctccaaagctcagcactgagaaacaaactacctgtgcaaagaaaaccgcaaatagatgctgtttgccctgtttgtttatagatgaattttcattttgcattatgcttttcatacgagtgcatcctaaaaagattttcacaatgaactgtgtacatgtagtaaagattgcaaaaagagggaaataataaaggataaaagcaaagactaaactttctaccaaagattttggaggaaaaagcgttggccaggataaataaaatatttttaaatgagtggtgtataattaaatggtcagagaaataactgaaggcaagtaaattgactttcttttcctttttttacatttcttatttctcccttgcataagacaaccaaggtttgagccagctgctgtcttcttcctatctatgggactttgagaagtttatttctgttacctccataagcctcagtctcttcatctgttaaataaaagataattggaggctgaggcaggagaatggcgtgaacccggaaggcggagcttgcagtgagccgagactgcgccactgcactccagcctgggtgacagtgagactccatctcaaaaaaaaaaaaaaaaaacaaaaaaacaaaaaaaaaaaaacacacataattggctgggcatggtggctcatgcctgtaatcccagcactttgggaggctgaggcaggcggttcacaagatcaagagatcgagaccatcctggccaacatggtgaaaccccgtctctactaaaaatacaaaaattagctgggcatggtggtgtgtgcctataatcccagctactcagcaggctgaggcagagaattgcttgattgcttgaacctgggaggcggagactgcagtgagccaagatcgcaccactgcacaccagcctagagatagagtgagactccgtctcaaaaaaaaaaaaaaaaaaaaaaattacaggacccatctctttgagtaactgtattaaatgtgaatgcagcacctagccacattactatgcacatagaaagtattcaataatgtttactgctattaatattaatatttccttcataaatttattaatattcattttctcccatcttaacccttctgggcccctcaatccactggacctgccttcagcctcctgcctctttactgccttcattcgcacttctttgagtcaggttggcaaaccccttcataatccgcccaatctagttttccagcccccaatactctcctgacctataaattcgctttctgcattggccacaatgaactcctcccaggtggcagctctttggatctctctatccttcctttctttgtgctcttttcctggaatgtccttctcttgtcatcctacccaagacaatcagtttctccctctatcgctccttgaattcgcctctgatattgcacttgtgtctgcatattgacaggtttatggaagacacttcctagccatcttgtgagctccttgaaggaactgtgtctttatctgtatagccccacctagcagatgctcaaggcatgcttgtggaatgaataagggaacagatcatttcttctgagctgtttgcagtctggctaagccaattgaaagaatgccttctcttgcaatctacaaattgaaaagcctgtgagaccctcaggacactcaggcaagttttccagcatatgtgacaataccaagccttagtgcatttgcctctcacgtggaggagtctcttctaaaaatgaaacagagatgaagggtgagactcttacagtggttcaactcccctaagatcctcttgtgatttagaagcatcttggaaagaaatccttgacactcgcctcgcccaccctgagctataaggtaaagctctcggtggtaaacgtggctccctggtagggagacttcttttatcctcattgtttctggagggggaagtgttagcacagagactccctgggaaacccgaggatgcctcaccacctcaccataacagcaggaaacccagaaatgattcacagctgaaacctctggcccacatcgacacatcacatcacatggttgtttcaactggaaaccaaacagccatctgggcatgattatctgtatttttgtgaaggtgtaaatacacagtgagtaggaagagtccaataaaacctattataatgttggtggtgggcaccacaaagagagcaccccttaatagacattccctggtccagtgaaagacatactttgtactgagtcccgcgcctgggagaccttccaggaaagtaaatccccaggagagagaggcatttcccagtaggtgctttgctttttggttgttttcttttcttggttgtttactttgttctactttgtttttactacagttctgtcctactggtggcggagtgggactccttcatgatgtggcacagtttccttgagttttaggaagaaacggcccatgtggcagattcagaaacaatgaatcagcacctaaacaaacaggaaggtaagcggccctcccaaggtcacctgggtagtggcagggtgtgaaccagagtccaggtgtcctgaccacccaccaccgcctgtcctcctccctcatacaagatcccttctaggccagcgctgagaataaaggcagcggcatcatggggagggggtgaggacagaagggtcagggaaggcactgggagggagaggcaatcccaacccaactccaacagcctagggtcaaagcccagctccactcctggcagctgtgagactttggtgcatttaatgtccttgagcctctatttcttcacctggaaaatgggattgatgacaatatgcgtccctccaacaactaaatggcacatcaaagctttggttaaaggggttggcacatcgtgaggaccacgtcagctcttaatactccaatgatggcttccctataagtgcagagtcttcttcaagtggtggttagcacgggttttgcctgttcctttaatcatggctgtgaatttgctccggcaccattgttcccaaagtagaatttactggcagcttccccccacccatgacccatctctgcttggaaattttttagtagtagtactggctacttttaaggagaactcattccactgttgcacaatggcagctcttagaaagatccctcttgaattgggataaaatctgatctccctctctataatttctccccactggtcttaacactactgctttgcttcccatacttggagaaatgctcccccagagactctaggtgatgtattggggatcagtaaacccataaaataaataaggcatgttttccttatgaatcaaattaaaatgaagatttcttagggaaacagaatttaagctttgcattgaatggttatgctttttaaaatatgtttcaggctgggcatggtggctcacgcctgtaatcccagcactgggaggccgaggcgggcagatcacctgaggtcaggagttcgaggccagtctggccaacatggcgaaaccccgtctctactaaaaaatacaaaaatgagccgggcttggtggtgggcgccagtaatcccagctactggggaggctgaggcaggtgaatcgcttgaacccaggaggtggaggttgcagtgagccaagatcacgccactgcactccagcccaggcaacagagcgagactctgtctcaaaaaaaaaaaaaattacatttcaatttaagatattttttattaaaacaaacaagcatattttagtatataatataaaattcaaatcatttctttttcagatttggcacaaaaaagtttgcttcgggcaaccattgccagctctatccagacctccaaggagtgagtatctattcacttgcctctgacactgaggatttctagatggagaaggctgagaaatgctactctgttgaacagagctacaaagaacaaatgtaattcctttcccatggggctgcccatcaagttttcctaagatcttacagttggaaagagacttagaagttgtctaaatcgatctcccttctgcagcaatcctaacagatggtcacccagcctccgctggatcaggctcagagcggagaagagaccacatggtaatcattgccattgcatcgctggccagctctgattgttagaatgttcttttcttaagcctagcgccatgcacaggggccctggaatgtggcagacctgaggtggactcttgaaccagccgcttcacctcaccggggctcagtttcctgtaatcccagcactttgggaggccaaggcaggcggatcatctgaggtcggtagttcgagaccagcctggccaacatggcgaaacgccgtctctactaaaaatacaaaaattaaccgggcttggaggcaggcacctgtaatcccagctactcgggaggctgaggcaggaaaatgctgtaaaatggggtgaatggtgttagctatatcacgaggaacaaaaaatggacaaaaagcccttagcattctgcctggcatgttgaaggattcaataaatgttccctatcatcaccattcccttccacagcttccataagctaaaattctagagcctgtttgtaatgcttctgcaacaccatgctttacatatttgaaaacagttaatatactctcccctggctgcacctaaaaagcttttgttcctaagttaaatatgcccccaccttccttgatagaattaacctcgaaacctttcagtgtatgtttttcagaaagctgtttgaaagcatgttaaaaattcttaggaatgaactggagaaatgtcagaagacaaaaagtgccacggagaaaacaaagggagcagaggaaagggatggaaaaggctagaatgcagggggcgggtgcagtttaaaatacaggagtcgagtagctcacattcaaagaactgggctttcttatgaagtttgattggagaccctggcctggaccaaaatggggcactccactccttctcagagttgcaggcagacagatctgccgtgcagcactggccacccaggctgaaaagcaggaagacccgaggaggggcttggcgagggcagcccaagtctgctcactgggtggccagaagcacagcatcatcctgtggcctccacagagagggccaggaagcaggaggtggggcaccaggagaccctgtctttacatcatgctccaacccctaaaaatatggcccaatgcatgtatcaagctctcatccatccaattaattcctccttctcttatagagaagagcaaccaaggcccggcatgatggctcatgcctgtaatcccagcattttgggaggctaaggcaggaagatcacttgagcccaggagtttgagatcagcctgacctacatagcgaaaccctgtctctactaaaaatacaaaaattagccaggcgtggtgacacatatctgtaaccccaggtacttgggaggctgaggcaggagaatcacttgaacccaggaggcggaggttgcagtgagccaagatcatgccactgcactccagcctgggcgacagagggagaccttgtctcaaaaaaaaaaaaaaaaaaaaaaagcagcaaccaagtgttaggaactgaactgtgtccctcagaagttcatatgttgggccaggcactgtggctcatgcctgtaatcccagcactttgggaggccaaggtgggtggatcacctgaggtcgggagttcgagaccatcctgaccaacatggagaaaccccatctctaccaaaaatacaaaattagctggtcgtggtggcgcatgtctgtaatcccagctactcgggaggctgaggtaggagaatcgcttgaacccaggacgcagaggttgcagtgagccgagatcacgccattgactccagcctgggcaacaggagccaaactccatctcaaaaaaaaaaagttagtatgttgaagtcctaaattccagtgtgactgtgttcgaagatagggactttatggagggacttaaggttaaatgaagccatgatgatgggaccctaatgtgatagaaccagggcagatcacttgagcccttgtaagaagaggaaaagacaccagagctcgcttcccacctgccgcagaagaaaggaccaagcgaggaaaccgtcagaaggtgatcatctgcaagccacaggagaaaccagccctgcccacaccgtgaccctggacttccagcctccagaactgtgagaaaatgcatttctgttgtttaagccacccagtgtgctattttgttacaacagcccaaaccaactcaaacacatagcatagcagttcctcaaaaaagtggcaatgttagtggaagtttcttcctttatgggttgaagcagaacatggggagagaagagttccccattgtaggtagattcttaaaataattcaatgctgtaattataacagataagaatgtaggctaaaactaaatttaaacaggaagttacttatttacctctagctatgagttcaatatattatcttattcttggaaaagaaagaaatgaaataaagccttgaacagaggaaacagtaaagaaataaatctgcatggaagaaaatggaaaaagtaaatgaagttggaagttgttaagtaccagtattctttaaattatttacatgaattcagatgtgtaaatcctcattgaaggcaggaacatttgtaaagtatttactggacgccatttgtaaagtcctttactggacgtattcagggggctgaactaagtgtggaagctattaataaaataaaaggtaatattgatcgtgcctttagaaacttctattttagaatgcaaatactaataatacccgctgagaatttagagactatcccttatctccagaggcactagccgccctgcaaaggttagggagctcaacagaagaccaaaggggctaacagcaagatggagcaggagagaacccatttacctggcaggtgtgagaagagtcaaggtgtttctaagcacacagctgaaaatggaaaacaggtgggtgctcctgagcaggggttgggggccagaaacaaagaggggcacccatcagcactgtgttgacaggggggatgaaatttcagagagatcatctgggcccaaacccacagagccgaagggcccggaacacgggtaacgggtgaatgtattcagtcgggcctcctgccgcttgtggacctgctgaggcctttgacgccacataaaccaaaatgagctgaggcttggagactgggtggaagcacttgggaatctcatttgacctgtggattttactgatgggaaaaaggagaagatgctcagagtggtggtcagctgctctgcccacatgggccacccaagagcacccacaacccgcccttacaccatgtccatagaaagggagtggtttttgggttcagaggagaaagatatcacttccttctgggagcaggcgtcgggtagagaaagggatcaggcaggtctcaggttacgcaacaagaaagctcaaaccacctctgtcaaactccctctgattctccttcatcctcctgttccagagcttggtgactaggatgctcctctgtgtcctgtgcaatctcacaggccttgagcttgttccccgggagtaacctctgcagaagcaggaaatgccctctagtcagctcttccgaatgtgagaaatgaaagccttaccaaaggaaagctgaggaaacgtgttcttccttccttcctcccatccttcctccctctcttccttccctccatcttttttttttttttttttttttttttttttgagacagggtcttgctctgtcaccagggctggaaaacagtggcaccatcatggctaactgcagccttgacctcccaggctcaaagaatcctccaacctcagcctcgcaagtagctaggactataggcatgtgccaccacacctagctaattttaaaataaaatattgtacagacacaaggtctcactttgttacccaggctggtcttgaacttctgagcgcaagggatcctcccaccttagcctcccaagtagctgggattacaagtgtgcgccaccatgcctgactaatctttgtatttttagtagagatggggttttgccatgttgcccaggctggtcttgcattcctggccccaagtgatcctcctgcctcggcctcccaaagtgctgggattacaggcatgagccaccacacccagcctccgtcccttctttctttatcttttcttccttccattcttcttctatctttccttctctcccacccttcctcctttcctccctttcttttttcctttcttccatcttttattccttccttcctcactttctccctctattgtttaccatttattgagccggtcagccctttgccaaagatcacagaatgcatataaagatatgttctagatcatgattttgcagtgcttacaaccttagggggaaaaaaaaaacggatgatgagttaaaaattaaaccagccggtgaggggccactagcttcactgaggcaaagaacctcgaagcatgattccatttccacagatggggccgcaggagaatattctgagcccagcacagaggcccagatacactgtgttcttctgggagtccaaatccagccctgagagccctgtgtaggagggggctacggctcagtggaggtttcctctgcctttaaaatagttctgggatgtgattttttgccttgagttactaagctgaaaaaacaagccagaaatacctattttgctcaaaatagcccagtcctcccttatgccaggttctcggaagctgccttgggtgcctctgccccacacaaactcccagcaccgcccaccttggtgactgatgatgtgggcagaggggagcagaatgggaagcagcagcttggcttctctgcctggcctctctgtgctcttttgttttgtgtttttgagacagagcctcactccgtcacccaggctggagtacagtggtgtgatctcaactcactgcaacttctacctcccgggttcaagtgattctcatgcctgagcctcccaagtagctgggattacaggcacgcaccaccacgcctggctaatttttgtatttttaggagagacggggtttcaccatgttggccaggctggtcttgaactcctcacctcaagtgatccgcccgcctcggcctctcaaagtgctgggattacaggcgtgagccaccactccaggccagtgactttttgaattacagttttttccagatcctgaagtctcccattcctgctcagtctctaccctctactcatcatagttcctgttttttgagtactagatactttgtatatattttttaacttgtctttaattattgtcctatttacagatgaaaaaactgaagatcagagaggttgtataacttgcctaaggtcataaaactacttaatgatgaaaatttaaaaccaagtctgtctgactctgtagccatggttctcactgtctggtccctggaccagctgtatcagcacctcctgggaactcatcagagacctaatgagtcagaaatttggggggtcaggtggagccatctgtgtcctggcaagcctcaaggtgattctactggacactcccaaccaagaaccactgttccagcacgttcccttcatctccacgccatgctgcgtctccaacttcctgctctccaaaggcaaaactcaccatgagggaatcatccagaaataaagttgattttcacttctccctgcagatgctcccagggagttaaaggtgactcttcactccagactctaaatttgaccccctttcaggcggccaccccaggttcattatcacaccaatcagccaactgttttgagtagaaatctcctttcccaccctgtaaggaattccaggacaccgtctatgaagagggaaatcataacttggctatttgttcaggacacccctaccctcttccagaccagcagctcattgagacacctgccctcgagataccacttgactactgccgccagtcgacaattattgatcaagtactgtgtcaggtcctctgctaggccgtttgagacatgttatctcaattaatccttacaacaacccaagaggtagacatgattattagcccatttcaaaaacaagaaaactgaggcacagattatttgcctaacttcactagctaataaattactgagatgagacttaaactcagtttgtctcaagaaccccatggtcttatccagtatgccctattgcctgttacgggcctttgtcaaacaagtcttctctcttggtgcactccaggccaactttctgtgttccagcttgagagtcctctttgcagccatgtgaatccagtgtcttcctctcgttaatcctctaggacacctctgcccagctttcttccatccccccgcacctggccatttccctctggagctgtttcctactagctgggctctcacctcccagacacttttccttcctttagaccagcttcatctcctctatgtgctgctcagcatggaataaattctatctttttccaattcccaatttctaaggcaggtttttttttttttttaatcttaccatctctgctttgaccagacacttggtacaacttcaaacattgtcgcctgtggtttggctgcctaacaaggagctcttggcccgcttcgaagccagccttcttgaagcctgccctcacatttagcgcccttaatatagactctgtctaccacagatcagcgtgtactgagaagatagatcggaatcagggaggaggctatttcattgcctggtggtggaaccaatactcagtctggtgatataaactgaaaaatgcaaaagtggggaaggcaaggtgaagagcgaaggcagcttctcagacttggctcgtgagttcatagtaaggcatctccaacaagagtcttgcagcggcctcctggagggtcccttccatccacagtgattggggcacaggctggctcaaccataaaggcaaacaggaaactctgccagcaaaggaaaaaggaagctctcagattcctgttccaagcagccttctgggaaggactttatcttgggggaaagttttactaaaggaaatttgacctgaagttgcaagtttcctttgttgagaaaagcaaataacatgaaaggggagaaaagcaacaagatgaaagattggtcatcacagatgcagatctaatctctgccataatataaactggaagaacctagaaccctgggaggtgagagtggcaggcggtgggggggtgacatgagcagaaacaacagacaagacgaggctgacctcccacaggggcagcgagggccctggctgaccagagaacaggacgaaataaggctttccagggcaggttagagtcctttagtatcaggatgcagtgtttataatctcatgggccatggagaattctgtgctctaagcatctgggaaatgagataatcaaagcatataaataataccagtcaacttttttaaaaaacggtcagtatttttaaacacatattaaaatcttcttgagccctttgcacatattaactaatttaaacctcacaacaaccctatgaaatacataaccaatattatcacttccctttataggagcacagaaaggttaagcaccttgttcaaggtcacacagtttgtaaggctcaaaagcaggatttgaacgcaggccatctggtactaacgtcactcctcttaaccaccatacctgactgcaaagcagtctctaaaattaacgaagtgtgatatggtttggatgctttgtttcctccaaatctcatgctgaaatgtgacctcccatggtggtggaggtggggcccggtggtaaggacagacctcccatgaatggcctggtgccctcctcgtggtaatgagttcttgctctgcggtcacaggcaatctggttgtttcaaagagtgtggcaccttcctagccctctctcatcataggaggtactggctccctcttcaccttcctccataatcgaaagcttcctgaggcctcaccagcagcagatcccagcactatgcttcgcgtacgaactgcagaactgtgagccaaaataaaacctcttttctttataaatcccccaatctcagatattcctttatagcaatgcaaaaacagactaactcaagtgtatcttcttcgctctgttctttaagaagtttggcaactcttgggatggtaaaagaggatagcagaaagaaaactgggttggaatcctaactctatgattgaagaaggggagctgggaccttgaacctcataaggtgattataagtaatgagataatatgcgtctctggcacatagtagatgctcagtaaatcattacactagctcatattcattgatgtttatcaagggctaagtatgtgctaggccctagacataaatctcctgaattgaattcaaccagattagatcgattttacactcctgcttcgtttcagggcatgaggaatgctgagagtcagcctcttggggaagttctcaaaacttcaactcaatttgtgtagtagttgtgcacaattcaggtgaggtgctcatatttcctcttagtcatattttaataaatgaaatatattctatagtttacaatcataaaacaactttctttcttctgttgtcccttcaaaccttctctttaagaggttctttctctgcccctagttgagatttcagacaaggcaggtggctttctgagtcattcccggacacaagggtcattttcagtcgcaggcaccacctcatttgagtattttaagtagccaggctatggtaataatacaaaccctgagcttttatttatattggagagtctcccctcttacagtagggcaagactgcagatggtgattgtttgccagtagccaggcagggctgtgtggccaatgtcctccccatctcccccactgaccctcctcgcacactccccagctgccgcttctgagccattcaggatcagactcagggcagtgggtattagaggaaaagagcagcagtcttacatgatggggacgctcagaacctggtgctggtgcccgctgagcctggcagatatgcaaagctgacccttttgtgaaagacactgcaggttgtcctgggaacctccaactcagttaacataacacaaacgtgaccgtatgtccactttgcagggacagttccagtggaattctgttgcctcagctatctgttagtaggcagctatttgagaaaggattctttctcaaaagtatctccagttaggtgataagttatagagcatcctacttaaaacagatgaggcttctctggaggcacaaagttcagcttccccccagagatctcctcacactggtcaccgcatctgtccaggggggtctatggacagagtcccttcaggaaggctccgggctgtctgcctcccgcatggctcaatctatatccatggataatggatgcctttcctcaccattgtctaggaaactgcagctcacacctactgcaactcactctccctccctctctttttgcagttcttccttctcaggcctatcttactgtcacttctcagtcttcatattcctcccactcccagtagtatacggaagccccctaaagcccctctcacttggcttacagtgaggggaagtgtccctcactcctctgctctacgagccttctaacacgtgcctccaaaggaatctgcactcttggctgttttttgtttttgtttttgttttttttgagacagtgtctcttgttctgtttcccaggctagagtgcagtggcacaatcatagctcactgcagcctcaacctcctgggctcaagcaatcctcccaccaaagcctcccaaatagctgggactaattttttatttatgcagacaagtgtcccactgtgttaccctggctagtcttgaactcctaggtgcaggtgatcctcccaccttagcctcccaaactgctgggattacaggcatgagtggccacgcccagtctcaactctctttaaaggttggaggtgggtgactattagtcttagcaggcctggttttatcatttcttagcatgtcatgaataacagttcctcttcatattctttataatgtggtgtcagttaatacctattgtaatattttctgagtttaaggattctgcccatcacgtgaaggacctcttcaaggagaactacaaagcactgctcaacgaaataaaagaggatacaaacaaatggaagaacattccctgctcctgggtaggaagaatcagtatcgtgaaaatggccatactgcccaaggtaatttatagattcagtgccatccccatcaagctaccaatgactttcttcacagaaccaaaaaagaggctgcattgccaagtcaatcctaagctgaaagaacaaagctggaggcatcacgctacctgacttcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagaaatggggaaatgattccccatttaataaatggtgctgggaaaattggctagccatatgtagaaagctgaaactggatcccttccttacaccttatacaaaaattagttcacgatggattaaagacttaaatgttagacttaaaccataaaaaccctagaagaaaacctaggcaataccattcaggacataggcttgggcaaggacttcatgtctaaagcaccaaaagcaatggcaacaaaagccaaaattgacaaatgggatctcattaaactaaagagcttctgcacagcaaaagaaactaccatcagagtgaacaggcaacctacagagtgggagaaaatttttgcaatctactcatctgacaaagggctaatatccagaatctacaatgaactcaaacaaatttacaagaaaaaaacaaacaaccccatcaacaagtgggtgaaggatatgaacagacacttctcaaagaagacatttatgcagccaaaagacacatgaaaaaatgctcatcatcactggccgtcagagaaatgcaaatcaaaaccacaatgagacaccatctcacaccagttagaatggcgatcaataaaaagtcaggaaacaacaggtgctggagagtatgtggagaaataggaacacttgtacactgttggtgggaatgtaaactagttcaaccattgtggaagtcagtgtggcgatccctcagggatctagaactagaaataccatttgacccagccatcccattactgggtatatacccaaaggattataaatcatgctgctataaagacacatacacacgtatgtttatagcggcactattcacaatagcaaagacttggaaccaacccaaatgtccaacaatgatagactggactaagaaaatgtggcacatatacaccatggaatactatgcagccataaaaaatgatgagttcatgtcctttgtagggacatgaagctggaaaccatcattctcagcaaactatcgcaaggacaaaaaacaaaacaccgcatgttctccctcataggtgggaattgaacaatgagaacacatggacacgggaagggaacatcacataccggggcctgttgtggggtggggggaggggggagggatagcattaggagatatacctaatgtaaatgatgagttaatgggtgcagcacaccaacatggcacatgtatacatatgtaactaacctgcacgttgtgcacatgtaccctaaaacttaaagtataattaaaaaaaaaaaaggattctgcccatctccgaaacaacaggaagagtgaattgaatttaatatctaattatgtatgatttaataaagaagaaggggaaaaaaccctcctggtctactaaatcctgaaaagaagatgattcctgtctcagtgcatgacccaaagctacagcagattccagaaatgcaatgttgaccctgcaggaaagtagctgagcaagtgcagccttagccagaatttccctcaccataaagaggggacagatgccaccaggtctgcctcagcccattttcttgaatttcttcttcaagatgccaatggatgtggcatctgaaagtctgattcaggtttatggcactcataccctggaaaaaaagctctgtacaagttttagctcagctttgaacatgtgaacaggaagtctatcctagtattgccccttctatatgggaaaacctggctgcacagctaactaaggtgtgcacagaaacatcagcctcgctggttgcagttctcagtctttcacccaatccaaaaggtagagaaggaagatgctcttctctgtgtcttcagggggttcacggtggtatccttcgaagctgaagggcagaaatccaagaatacgaccacacagaggaatcactgtgttcacctccgtttttcctatgggtacctcgagaagactgctgggcattcccaggccacaggttggctcagtagcttagccaggaacaatctgtgaggcctgacttttagctctgtgtcctgctcactatacaactcaagctctgtggagtagcgtgtctgcagaaacaaagaaaagctttttagagtaatcgcaacttttcccacaagccgtgttttcataggagctttttgctttttttcccagcagcaaggtaaagcaagcaattgaactaacttgttctcagatcaacgagtccattgtgtgcttcagggagcaaaagggtgttttgttgttgttgctttttttctctctttcgatgttggtttggagcagaaattaaacttggccatgggctaagagggaaaagaactggatagacaactctttctttctttggttgggattcagatttctgtaaaaatccataggtttataagtgaaattgttactaaatatgtacctactgatacacatgtcctctttcaaacaccccttcaccctgctcctttcctcctcacagtagcgccagctacactccagaacactaggacaactttaataaggggctaaactatttgtgcctgacattgcttgattatcttgccaggaaaacagatgcaaggtcctgaggtactatctcaaatactggcaaagaaagggagattgaaaagttcatgcttaccatgaacaaaatttcagatcaaaattctacaatgtcctaatctacttacaaattggggaaaggagtggcactattttttccctgtttctcctctgctcacaggtgatttcaacagagtctgttctcagttctggactagtttaactgtaactggagccaaaacagctcaataggaaagaactgtttttttcagcaaatgatgctggaacaactggatagccacatgcaagagaatggagttgggtccctgtgtcagtcagcttgggctgccatcacaaaataccatagactctggggcttaaagcatagactttattgtctaacagttctggaggctggaagtccaaaatcagggggccagcattgtagggttcctggcttgcagatggccgccttctcactatgtgcgcacatggcagagagggagggagagagagaggcagagagagaaagatcttccccttcatacaaagccacagtcctatctgaataggctccacccttgggagctcatctagccataattacctcctaaagaccctatctcctgatacagtcacactgggagttgttaggacttcaacatgtgaatttgggggagatacaattaagtccatagcagtcccatcctcacactacacacaaaaactaagtcaaaatagatcagagacctaactgtgagagcaaaaactgtaacacttttcagaagaaaatataggagtaaatcttcaccaccttgggttagaaaaggccttcttagaaaagataccaaaaatacaaatgagaaaaggaaaaaagatagataaatcagacttctaattaaaaactattgtgctttaatggacaccatcaagaaagtgaaaagacacctcgtacaatgagaaagaatatttgcaaatcatatacccgataagggacttgtatctggaatatacaaagaactcctacaactcaataatagagacaaagaattaaaacataggcaaagaatctgaatagacctttctccaaaaaacatataaaaatggccagtaaacacgtgaagaggtgttcatcattattaactatcagaaaaatgtaactcaaaaccacaatgagatatcacttcatacccactagacaactataatcagaaagaaagataataacaaatgttggtaaaaatgtggagaaattcaaatcttcaatatgccgctggcggaatatgaaatagtacagccactttggaaaacagtctggcaatttcttaaaaggttaaacctaaagttatcatatgaaccagcaattctattcctgggtatatactcaggagaaatgaaaacatatatccacacaaaaacttctatacaatgtttatagcagcattattcataacagccaaagaccaaaagcaatccaaatgtctgtcaactgatgaacagacaaaatggtaaatctatacagtagaatatgatttggccataaaaaggaatgaaatactgatacaagctacaacaaagatgaacctagaaaacactttgctaagtcaaagacgccagtcacaaaagctgcatattgtatgactcaatttctatgatatcagagtaggcaaattatagagacaagaaagtagattagcgagttggcttgcgtagggtggggtgggaagaaacagggagtcactgctaatgggtgcaggatgtcttcggggggtgatgaaaatgtcctaaaaatgattgccatgacggctatatggctctgggaaaatactaaaaacaattgcgttgtacattttaagtgggtgaattgtatggtatgtgaattacaactcatcaatgttgatagatgtgtgtatgcatatatgcacaactgaaaaaataacattccccgagatttgaaacagaagcaaaattaagagaaaacgttgggagttagacccaacatttgggctttcattcacttgggagaaagcgtcaaagtgtctgaaagctagaaaaatggaattaagggaaaatatactcaggaaaaccaagctggagtgtagattgtgttaagctgaacaaaataataaggcactatcttgtttaaagaggacagagcactagcatatgactttgaccatgcttagaatgcttcctgataggaaggaaaaggaacccacacagaccagccacatctccttccctggaagtgaccccatctgtgatacgtgaataacacaactcttcccccaattataaaaataacatatttaagatagtataaaaatgcagagaatggcgcgggcaggaatcatttaatcttgccatgcaaagataagtactaatatttgtcagaggtccctcctcagcacattgttccatatattcaagctcatgcaatacatacacttttgtatctatattttacacttaaaatcaacatttttcattatcatttcaaactctcataaatattactttcaatcagaagaataaaccataatttatttaagaattttcctaagccagggcttttatcttttcaatctttcacttttttttaaatgttgcaaagcaaattttgagcatagaggccaggcatggtgacacatgcctgtaatctctgcactttgggaggctggcagatcgcttgagctcatgcatttgagaccagcctgggcaacacagcgagaccctgtctctactaaaaatagaaaaaaatagtcgggcgtggtggtgcacacctgtggtcccagctacttgggaggctaaggtgaaaggatcccttcagcctgggaggcagaggttacagtgagccaagatcatcccactgcactccagcctgtgtgacagagcaagattctgtctcgaaaaaaaagaaaaaagaaaaaagaaactttcgagcacagatttgtcttatcagattcaattatttcttaacatataaataattttatactaaaaggtgtgaaactagtggtcttcatagtgctaatcaaaaatgttttattaagttggtgcaaaagttattacggtttttgccagtatggcaattacttttgcaccaacctaatactaacttatacattaacagcagtaggtgatacgcccattcactatcaaacatgaggactcctgttccccttccagaaggaatcctaaggaaagaattctcactgcagcatgatttaagatagcaaaaattgaaggaaaaataaatagccatcaatattggaaaagtaaaatagatcctggtgagttatttttcagtgattaaagataagtggtttcaaagaatatgaaaaaaaagattttcagcctaagcaatgtagtgagacctcatctctactaaaaataaaaattaaaaattgtccaggtgtgatggtgcacacctgtagtcccagctacttcggaggctactgggaggatcgcttgagcttgggaggtcgaggctgcagtgagctacaatcgagccgcagcactccagcctgggtgacacaagctgaaaagaaaaaaaaaaattcacaaattctcaaaagaaatggcttgtatgtcaaacaccaaattctttgtgagctcgggtaatataaaaacacaccagcagtgtaggccgagcgcggtggctcactcctgtaatcccagcactttgggaggccgaggcgggcagatcacaaggtcaggacatcgagagtatcctggctaacacggtgaaaccccatctctactaaaaatacaaaaaattagccgggcgtggtggcgggcgcctgtagtcccagctactcaggaggctgaggcaggagaatggcatgaactcaggaggtggagcttgcagtgagccgagatcgcgccactgcactccagcctgggcgacagagtgagactccatctcaaaaaaaaaaaaaaaaaacaaaaacaaaaacaccagcagtgattaagtctgggttgtgggatcatgagtgattttgtttacttatttgcacttttctctatattccaatctgcctatactgacaacttactactttcatagtttttaaaaatctttgattttataaattagcccataagtaaatttgctttcagagactatcctgcatagaaaaggtggaaggtggaaatccacaggtgcaattgaaacatggtcagggggccaggcgcagtgtctcaagcctgtaatccaagcactttgggaggccaaggtgggcggatcacctggggtcaggagttcaagaccagcctggccaacatggcgaaaccccgtctatactaaaaatacaaaaattagccaggtgtgatggtgtgtgcctgtaatcccagctacttggaaggttgaggcaggagaatcacttgaacccatgaaacaaagattgcagtgagccagtgggcgacagagcaaggctccatcagaaagaaagaaagaaaagaaagaaagaaagaaagaaagaaagaaagaaagaaagaaagaaagaaagaaagaaagaaagagagacagagggggggggagggagggagagagagaggaaggaaggaaggaaggaaggaagaaggcaagaaaggcaggcagtgggggatccggagtcttgcagctctggcttctagctccatccatgctgccttctgggtgtgctttgtgtcaaggccttgactggacctcattcctcattgttacagggaaatggcaggctacctgtatgcactaatgatcctgagcccatgttcctcaagagtgccatcccagggctgggctgcagccgtctaatgtgcattaacagttgatgcacatgaggcaagcatccaagaaaggattctacatttcctgccaagcatgggagaaggtgaacctggataatgcttgcacttgggaagctaaacacaatttcagcttcaaggaaacccccagattgcaaaattcttggacagaaagcaaaatatatctaatatttctgccaccatctctgtgagttttctgccaccattctccaccatgacctctgatctgtctagcagcctgctggatttcacacgagcaaagctaaaatgggaggaaagagggcatatgaaaaaaaaattagattgacagaaaacccagagtcaataggacagtctagactccccagcttgtaaactattcataatgactcactcaatagtcaggcattgacaacaagctgaatgactgtggacctagagctacaatattggcaatgttatctttaatttgaagagctcaaataattctgggaggcattaatcaggtaaagaaacacttgccctggatcaaaaattagtgtcagttggttaccaaggatgggaatatggttaaccatattcttttatttcccaggttattgtcataacatctctgtataattttatatacccatatgcacaagtggccagaaatccctttctagccagcagggacccacaaggttctgtttagcagatttatcccaataatctatcctcattaatactgtataagaaaccacctaaaaatccaatggcttaaaacaacaaggatttcgctgggtatggtggctcatgcctgtaatcccagcactttgggaggtcaaggtgggcagatcacctgaggtcagtagttcaagaccagcctgaccaacatggagaaactccatctctactgaaaatacaaattagctgggcatggtggtgcatggctgtagtaccagctactcgggagctgaggcaggagaatcacttgaacctgggaggcagacattgcagtgtgccaagatcacgccattgcactccagcctgggcaacaagagcgaaactctgtctcaaaaacaacaacaacaacaacacaagaatttagtctcacgtctacaggtctgcaagactgactgtggttcagcggctctaggctgagcaaggctacagttcggctgtgcttaacgccaacctgtccttagctccagcctataggttgagctgtaggcaagcgtgttcattctgggcctaagctgagtggataacagctgcctggggaaagttcttcccatcatggtcactgagatacaaaaagatcaagctttaatgcgcaagctcttttcaagcctctgccatcacatctaacaagtattctttttggccaaacccaaagttaaggggcaagaaggacactcctcccaccatgaggtcacagcaagggtgttgatgaataattctctttaagtgctgtgatgaattgagaatagcaattctattatccactgtgatggttaaatctccactggttaaatcttgaccagttcctcttctgactacttctgattttctcctttggcttcccagaccacatgcacaacccctgcaggtgagccagaatgccaagaagtcagcattataaggctaaatagagaaagaacaagttttctttttggaaagttcctcccaacctgcgatgtgtcaagacatcaccattaattggaaggggacacgattatgcaaaataactgagtataaagaacttagagacaaaaggggagtgaggggaggaaggagatgtagcagtttgaactatacgaggtttaaattaatttcaaccaaaacataacaagcaaaggatgttctcctgattatcttatgtttactattatatttcaaaggcaatacatgcttattgtgtgtggggggaatcaatctagtgagtagaaaacacaaccatctaaaaccccatcacccctaattagctgccattcaaatcctttatacatggactactttgggcattggaaatcaaggtgctgctacctaaacagtgtcgtgaaaattttaaggctctgagaaaatgttaaggccatttgaacaccagaaattcttgttctcatctctcaactacaaatgcctaggtgagttctcgcttacagatttttttcaaatttacagtatatgcaatttatttatttatttatttttgcaaaaatggggtcatctattacataccacttttcacattagaacaattttcctcatcaacaaagatatgtctatatcatcattttaaattctgccttatatttcatttataaattaccataaattacttaaccaacaccccattgatggaagtttaggttatttccagtttttcacaattactttctgcatgcataataactcacgtcacttcatatacaaactgaggcatttattttcattttcagatctaagaaatctaagcagtgccttattgacaataaatagaaccacccttgtggtgttaaaatgtgggcagcaagaaaggaaatagtgtggttgggtggagattagtcatttttgaaagagcacgtatgtacattttgcacgttggtgacaattcactcaaaattttaaagaacccagcttaagttttgaatcagcctgaagcactccgaacttcagatgctcatctcagcctcttaagtctgccaaccaagctggagacaaaacaagatctggctccctggtggccgcctgggaatcctgcccttggcgtcatttctggaagggcaaaagaaccctacggactcttgtatcactaggatagaaatgccacccagctcctcagcccatctccatcaccatggcagtggggaggggcctaggcattatcagaatgggtcaggactagctcagagccagtgtcaggctggctgactgtaaactaagccaggctttcaagggaaggcttttgaaggaaataagccaacaaaacagcatcagaaactgaggaaccattccttctccaactctaccccccaagagataccaaggtcacacaggatacagcagttgttgaaattattactgctatggaacagagcttttttggcaccggaagaagtcattctcttctgtcaaccctcttttcctttcccttggattttcaatcctccccatagaaaatcaagaccgcccagcaaagaacatgcttacccaaaagaccacagtgccattcagaaacaagaaattccaactctaccatacatataaccttctatccatcctctgaccttctgacttcataatgtatcttcccaagataaatagatgcatggcatgttaaagcctaggaggaccatggagattgtgtcaatatctttatccttcagtgaatagatggaggcctcagagaggatgagcaacctgcccatggccccacagaattggtggcagagcccaagactgttggcccccaaccacactgtccagacttcaaaagctgatcctcttgccaatgcccccacactagtaacagcctttttgcctgaatgtctctcagtgatgtcatgaagacaaattactgtctagctgtatggttctttagtccttgctgtatgttattgtacctggcaggccctcatggaaactaagctggaaagaaatgaaggagctcaacttggttaaaaccattgacagaacactcatcccccatcttttgctctctagacaaccgcaggtaaatgtgaggcgtttgagagagttaagccttctgtatcagttaagctaaaagaacagtttatttcatacccctaaacttcacaggaatagaacacaagctaccaggcagcaagaacaaaggaacagactagatacatttatttttcagaaattttaagccatggaagaacaaaaaaaaattcttcaaagaaaatttaggggcaggggattgaaatacatgcaaaacttatttttagtgccctttacagatataaagtcatgctgttcgtttaggaacaaaaaaatgcattatgtataacttgtttcactcataaaattaccatgttttgtatattgatatatttagacattgggagatctgaaaaaagcatttttatgatttctttcctggttattttctcgggcaaaagggaggtttttaaaaaaaaaaagtcctcagtggaaaaacttttcagaattttgagaaaatttacagattttagaggatttttacttttcccaaaatgactaagtcatcaggttctcaagtcattgaactctaatgtgttcaaccagcgtcctctacttatcaagataatagcacaaccgggtttagtaatggtgacctattgtggaactttcaaaagtccactgtagaagtcccacaaatttgaaattcactttgccctccaaggtaaatcttttctgttcttcccactgtagcactacttaaagtccatttctagaaatgaactgggagaggtcataagtcatttaatttagaccctacatgagcacaaatcctgtctatacgaggtctacaaatggtcaactatcccttgcttctccacagtcaatggtctaaggcctaattgtcatgctttaccatatacatttatgaatgtgtgatgatctgagccatttctgtcttcctcactagactgcagctgccatcagggcaagaagcaaaccttctctgctgactattttgtcctgaatgtctaccagcaatgggaacagagcagtaaatctatgctcatatcttctgagatagctcttaatattacaatttctctctgtgtattgaacttatattactttccctataacttctatgtactgagtggattctgcccttcttgtccatctagatctttcacaagacagcccttcaaatatatgaaacatgtcatcctccactcttctctcctctaggctaaatatcctgtttcttcagcttctcctctaggctaaatatcctcagctgtcccacatgtggtgtgatttttcagttccttcattaccttggatgcccttctcggaagacatcactgctctggttctataaacccacacggctaacatggaaggggagcagtttctggaatggaaggttattgacatattaagcgatctcccccaaaaatggttccaaagtctgggactaaaccagaaccctgtaatgctctttgccacaaactgattggtgaccaagtcaccttctacagttacataaggcatttagaaagacacaaggaacagatagaggagtgactggtgaccaagactgctagttgtccgctaaaatacattctccccttcctctatggcaatacaacccctaatttttagctggacatgtagctgtctacagtaaaggcagtgtttcccaacctgtcttgtagcttagtgtggccctgtgaaaaagtttttgttaatggaatgagttaggaatggaatgagcagactttgagaaccttccctaagagatggcacacctgcactcttggcacagctgctctatatttcttccattcttttccctcaaatgccagcatctgagactatgagcccaaagtcacacacaaatcaaggagtgtctgtctacaatacttttttttttggtctgaaaaagaaataaactgctatcatgttcaaaccattgttaccctgggtttttgttgttgtttttgttgttgttgctgttgtcacagccaaaactaatcctgatagtctattgctatgtcttcaaccttattcaagtagttttgtaactgaagcagcacatggtgtaattaaacacgaacctgcaagctgataactttcccagtgtcgcctaccctgccaaggatgagggtggcaagcttagggtctggcatcagagagggtgtctgcagctctaactgaaaagagcttccaagagctgactctcttcccagtaaaaaaaaaaaaaagaaaaaaatacgaagagaaaagggaggtgatgccaccatacaagaggaaggcataggtattattttgcaaaagaggatatactatttttcttctcccttcattacatttttgagatttaatggctaatttcaaaattgcttaatgggtcaaaagcacagccctcagatagagtaggacaatccatggaccctagggaacctgcagagacgctcacatggaggtgagtggcaggaacaccaaatggcggagcacgcctgaggccggggaaaggcaagtctagaagactccaccttcacaggtaggggtgacaggcttcccaaagactggaatttcagctcccatgtgccatttcctgatttaatgtcagtcatttgccagttcttgttaaaatcaaacttctattacaaaaaacttagaaatggtcaaagtactaagaagaggcaggttgtagtagctccgtattttcaaatattcccaggcattatgtttctgcttagaatgtagaaagtcacaggagaccatggttctccccttacattaagaacaagctaaataagctactaatcatgttctaaaactcatcacaaagagctgaggacacaaagaaatgaaaacaaagtaaattccagaaagtgataagcactttctaggagaggagagacctatggctgctttcatccctgacagagtaaagaggagaaatcagccagagacagagataaggagaaaccagccaaacttttaataaaagttaattattgcaagcgtgaagctgggcacggtggctcacacttgtaattccagcaacttgggaggccaaggtgggcagatcgctcgagctcaggaattcaagaccagcctgggcaacatggtgaaactccatctctactaaaaatacaaaagttacccgggcgtggtggcaggcacctgtagtctcagctactcaggaggctcaggtgggaagattgcttgagtccgggaggttgaggctgcggtgagctaagattacaccactgcactccagcctggttcacagagccagaacttctctcaaaaaaaagcaagtttattagaaactttttcctagaatgcttctatcttagaccatgacctactattaatagaacaccaagcagctccagcctcagagcaagtcggcacctacccacctcttctccataggccttcactagtgcatgggactactagacagaagtctgaaggcaaagcaagagacctaagagagtgccgcacacaccttgaaacctctggaaaaaatgcattttccatacatatcacttaatcaagtaattttgtgccgtatttcatcatattcaagacactatcaattataagatgcaccattattttaggaccactacatataactaatgtattaaggatagtaatgtgcaacacatgaatgactcacactgtcctctcgttacctagaaatctgagatttgcttatttctcctgccttaggttgcagcgtttcaaatgcaacagtgcagtgtcataatgtaatctttctgaagacatttctgatcccacttaaattcaacatttgtacttctgacaatgaacataacccaagtgaagtgcagacattgtgccaatctttgaagaagctcacacataagtaaacaatgactacgtctgactgctgcctggcccacaatgtttgtgagacaccgctgctggtaagagacttcccaatttcagaggttaatatgagcccaaaatgtgcactttaggatcatcacaatatgaacaaaaaattttcctcccgatcagtactatctatgactcttctgttacttgtgtatttctaaatgtcttatgtatctatagaaaggaccccacatttgcattttcctttctcttctcatcattatgtctattcagagttctctccttcagtggtgatactagatttttttaattgacagataaagttgtatgttatttatcatgtacatgatagtctgatgtacatgtatttcaagctaagcatggtggcttatgcctataatcccagcactttgagaggctgagacaggaatttgcttgaggccaggagtttgagaccagccttggcaacatagtgagaactcatctctacaaaaaattttgaaaattagctgagcatggtggcatgcacctgtagtcccagctactcaggaggctgaggtgggaggattgcttgagcccaggagatcaaggctgcagtgagccatgatagcaccactgcatactccagcctgggcaacagagtgagacccccctccctaaagaaaaaaaaaaaaaaagcatctcctcatattccttacatagtcattacttttgtggtgagaacacctaacatctactctcttagcatcagaggtgatattttaaaataaggaatgaagtgtgtgtagaagatagtcaggagggatatccccaaaatacaaatattacctgtgggtggttatctatgagtggtaggataacgggtgatttttattttcttctcttggtttattatattttataattttccataaaaactattattacttgggtaatttctaaacatttaaaagaaataagcctaatgcaaaatgttttaaaatatcatttgaaaaaagggtaaacaaaatcaaaatacaaatgatagctgggataaatacatacaacacaaaataaccaatatccaactcaatacaatagaacaggcaactcactcaagaaggaatacacagggccaataaatgtatgaaaagttgctcatctgaattaaagcaacaaagagatgccatttttttttcactcctcaggttggcaagaaaacattgtttaaattaaaaacctatagcattctgtgctagcaagcatgagaagaagcaaccactctcacacactgctaatggaatgggaatcgctacatccttttttggaaatccggatggtaacagctactaaaaattgaaaaacacatagcctttaacccagcaaccccacctctaggactctatgctatggaaatgaaagtgctatatatttgtaagtgaatttttagttttagaatagttttaaatttacagacaacttataaaaatagtacagggaatttgcatacaccctacacccagtttttcctacaaacatcttacattagtatggtatatttgtcacaactaatgaaccaatattgatatattattaactaaagtccatattttgtacagatgtccttagttttcacctacatccttttactatttcaggatcccatccaaggtaccacatagtatttgatcatcctgccttctaaggcagcagtccccaacgtttctggcaccaggaaccagtttcttggaagacagtttttccacagacatgaggggcaggcagaggaatgagatggtttccagatgaaatcattccacctcagatcatcaggcattagttagattctcataaggagcccacaacctagatccctcgtatccataaccatagttcacgttagagcttgcctcctatgagaatctagtgccgccactgatctggcaggaggcagagctcgggtgctaatgctctggcccacctcacacctcctgctgtgcggccgggttcctaataggccacagaccagtaccagtccaccgcttgggggttggggaaccctgacctttttttcttttctttcttttttttttttttttttgagacagggtctcactctgtgacccaggctggatggagtgcagtggtgcattcacagctcactacagcctcagcttcctgggctcaagcaatccactcacctgggccacacaaagtcctgggattacaggtgtgggtcaccatgcccagccaggggcccctgttctaaggctcttctacactgtgacagtttctcagactttccttgtttagtgtttatctaattgacaaataataattgtacctattcatggggttcgtagtgatgtcttgatatacataatgtatagtgatcagatcagggtaattagcaaatccatcatctcaaatatttatcacttctttgggctgggaacattaatatcctcctcctatttgaaactatatattaactacagtcatgttacagtggtgtagaacactaaaacttaatccctctatttagctgtaattttgtaacaaatctctccatatcctccccttccccttagccttcccagcctctagcattctctgttctactttttacttctacaagatccatttattttagctttcatgtaagactgagaaatgcagtgtttaactctgttcctggtatatttcacttaacatcatgtcctccagtgccacccatgttaccatgaatgacaggatttcattcatttcaatggctgaatagtattccattatgtatatataccacattttctttatccattcatctaggttgattctatatattggctattgtgaatagtgctgcaataaatatggggctgcagatgtctcttcaatataatgatttcccttcctttggataaatgcccagcagtgggattgctggatcatacggcagttctatttgtagttctttgaggaacctccatactgttttccaaagtaactatgccagtttacattcctaccaactgtggataggagttcccttttctctgcatcctcaccagcatgttatttttttgtctttttgatagtagccatcctaagtgagatgcgacgataccttattgtggttttgatttgcacttccctgatgattagcgatgttgagcattttttcgtatatttgttggcatttgtatgtcttcttttgagaaatatctgtttaggccatttacccatttttcaactgaattgtgtgctcttctgctgttgagaagtttgagctccttgtatattctggatattagtcccccattggatgagtactttgcaaaaattttgtcctattctgtaggctgtcttttcactctgttgattgtttctgttgctgtgcagaggcttagcagtttgatataatcctatttatttattttttggttttattgcctagtaagcactcattttgaatgatatatttacaagaatatttactgcagcattacatctagaggtaaaaactagaaacttcttaaaatccattaaatgaagattaaataaatttgggaacacccatacccttcagataactctaaagctattaaaaagaatgatttagctattttgatctggagagagatccatagcaaaatgttatatgagaaaaacaagtcacatagaactaaatacactttgatcctaatttttcgaagtaaatttatatatttttattagcttgggaaaagtcatgaaaagatgcagaataggtcattgtcattggttaccttagggaaccaggggtagaattgctgaaatgaggccgggcgcggtggctcacgcctgtaatcccagcactttgggaggccgaggtgggtggatcatgaggtcaggagattgagaccaacctggctaacacactgaaaccccgtctctactaaaactacaaaaaattagccgggcgtgatggcaggcacccgtagtcccagctacttgggaggctggggcaggagaatggcgtgaacccggggcacagagcttgcagtgagctgagaattgctgaaatgatgagaacaatgcttaatttttttacttctttcttcatattattttactagtgataaagaacatctgtgaattctccaattttggaaacgtaatttaatagaagatttttttaaactgaagaatatatgccgtgcatcctatctttctggagtggtgcagattcaagatttggtcttcctccaggtgacagaatgaatccatcttctgcttagctgagttaagccaataagtttccttaggcaacctgattctttgcctgatcttttgatatattaacttttttttttttttttttttgagacagagtctcgccctatcacccaggctggaaaacagtggtgtaatcttggctcactgcaacctctgcctcccaggttcaagcgattctcctgcctcagcctccccagtagctgggattacaagcacgtgccaccacacccagctaatttttttgtatttttagtagagataggattttagcattttggccaggctggtctcgaactcctgacctcaggtgatctgcccaccttggcctcccaaagtgctgggattacagatgtgagccaccatgcccggccatgatgtatgaatatttttatgtttttatttcttgaaaaaagttctagtgtagtcattctatcataaggctaactggatacagcatctctaaccaaactatgccatgccatcatacgcaccccaataattccaggaaggatgttgtgtggttaagtgagaaagagttgtcaatccttggcaagaaggggggtaatgttcccaaaagtgaatgtaagatgaagatttgaaagctgttccaatgagatctctttggttccttccattctagcccagtctccttgcttccatcagccaccactgcagttcagtcgggccgaacagctgtacaattgagagggatttaaactgtcccccaagtttgcctcctgcacagcacccagagttctgctgaagatgccaacaggtgccatgcatccatgccagcacaggggtcccttagtgagaaaggccctcacagccacaataaccatccagtggggcttggcaatcaagaacctaattaaaagataacttgtcaagagaaactctagttgaagtctgccccatctttacatgaaaaatatgtggctctgttataacagtggtcaaacctctctcaaaactatgagaccctgggagaaagcagtgacattcttctatttgttcttttcccaagaatagggaacaaaaaattactttcctctgcttttcagtaattaccaaatcaaatggcctgaagctttcttactatctaaccagaaagcagatcccttgccagattcctagttgataaagtcatcaccagacaccgtattgtggctcctaggctttcatctggggacacagattggaagggaaaaaaggcacaggcttttactggtctgggaacggtcagatgataaaatcgggatctgtgatgatccagcaagcatccgctgagaggcaagattatttgaacactaattattcttatgtgcctgatagttcaggaagacccatgagcctatatttctccccatgcttcaactgcacatataaaattgctgtttataccaactctctcctccaggcagctgtttacccaagagagaggcaggactttggagttcatcagcttccaacaaattttcaggaaggagcccggtatattctcttctacccacgtgttccgaacttattacagacaagacagcgggaggatctcagagaacaagagcctaaaactagtgactactgaggttacagatagagtggacaactgacatttgcctccttaacatccattctacctttttttgcctacagctaaagacttttgtttcaggaatatatcagtcagagttgtccaggaaaactgagtgggcacacacacacacactcacacacacacacacagagagagagagagacttattatgggaattagcgcacatgattatgaaactgagaagtcccaccatctgctgtctgcaagctagagaagcaggaaagccaatggtaattcagtctgaggccagaggcctgagaatggtgtggggactgctggtgtaactcctagagtccaaaggactgagaaccaggagctccagtgtccaaaggcgggagaaaacagatgtcccagctcaaggagagagagtgaatttgcccttcctcttcctttttgttttattagaacgctcaaacagatgagatgatgcctgcccacactgatgaagattatcttctttactcagcctactgattcaagcactaatctcttttggagacaccctcccagacacacccagaaataatgtgttgcaagctatctgggcatcccttagctcagtcaagttaacacctaaaatcagccctcacaagaatctacctctccttctctcagtcaaagcgctgcattctctgcaataatccaatagcacccataatatgcaatagcaccaatgagatgaaatggaacttttgctgggacttctggaaaagtgacctgatatgttttcccctgagacttgaaggtgagaagaggtgagcgtggagttgtgcagccaccgtgaccccaaaggaagagactctgagaataaggccaagatgaaggtggctagggtcatgacatacatagaaagggggcatgatggcagcaatgtgaaaacaagcagccccccaggcccagagcatcacatgaataataaattccctttttgcctaagctatttggggtaggactgcttttgtcgagtgctaaagaaagcatcctgtctgataagacatgatatggcaaaaaaaaaaaccacaggtcagaatgagaccagtcacatgttctctgttttccattttaaatttccaagcatgtgctcactattcacatggccaaggaaggtgtcacattatcacctgaggaggggctccttccagtttgtttcagccttctgtaggagacatctattttcagaacaagaaatcctgatgggaggccaatgtattgcttactgtcattttaattttattcttattaatagtaattacgatgcatctctcaatatccagagatcattcagttaatccaacattggcaggaggtgtgttctccacatttgtggagacagttttgctattagtcatccacattctcatatggcccccatggtgacaatggcttatccaaatcctccctagtcctcctgtgtgttttaattaagttggccactctacactagccacttaagaaagatagggttattggggactgtacacagcaaaggaaaagatagagaagccatcactctattctcccactctaggtcccaatgcagcgtattcctccaatctgatatttcttgctcaggatgaatgaagcatgaggatgttcattacctcccttaacgtataacttggcaattgaaagacagtcccctctttttttttttttcttgcctttcttttatgatggaaattgtaaatatcaggttaggtctcaaattatcatccagctaaacaagacatgcaccaaagcactcactctgaggaggacttacaactctcagggtgctcccactcatccagatggctaggaaacagctgatccccctctccatggccatgagatcagaatggggacctgcccttcattggctagtttctttttaagatccaggcagaggagttgagaactaattgttattggctgtgctagtgtattgtcctgagattcctgtgccttcagaagagaatttttggaggggctgaggtcttagaaagtcagacaaaataactgctaaatgaacactgttgatttccaaaccaaatcatacttaatgactatgcctggccaggcacattggctcatacctgtaatcccagtactttagaaggtcgaggtgcgaggattgcttgaggccaggagttcaagattagcctgggcaacctagtgagacccgtctctaattccaaatttttttgaaaaagaagaaaaaatatctacacctggctgggcatgttggctcctgcctgtaatcccagcactttgggaggccgaggcaggaggatcacctgaggtcaggagtttaagaccaggctgtcaacatggtgaaaccccgtctctactagaaatagaaaaattagccaggtgttgtggtgcacgcctgtaatcccagctactcgggaggctgagacatgagaatcacttgaacctgtgaggcaaaggttgcagtgagccgacagcaccactgcactccagtctgggcaacagagggagactgtcgcaaaagttacaaaaaaaaaattatatatatacatacacatatacacctaacatgatcaacgtggcttttccttcacctttctccaagggcaaaagttgagtaacaataacaatattctgtgggaaattcctggtctgatacatccaaatccttccaaattggcacttgtattccttttcctttactttctcaaggtgagataatcacaaacaggatttaaagaaacctcacacatgctggcaaggtggagagtaagaatgcacaacggagccaaggaaagagaacaaggctccttcccacctggccccacgcatcttatcagctttaactccaagagcctgtgttcgcctcttcctcgtgaaggatggggcacctgacgtcttgcagctgaacttacgattacattgcagcagaacacatcaaaagaacaaatccaaataatgacataagggaaaataatcaaagaaattcaagaagtaatccaagaaatcatagccagggagcgtcagtgcacagagaactcagaatcctttccaaaatcaaagaatcattgtgtcagtaaaattcagaagagaaaacacacaaactgcttttcctctgctttcacgcaacaaacaacacggacacaagctgcatgtccttcaattcaatgccaatgctatctatctgaagatagcatcccatcctgttaccggaaaggggccccgatccagaccccaagagagggttcttggagctcgcgcaagaaagaatcgaggcaaatctaaaaagtgaaagcggccgggcgcggtggctcacgcctgtaatcccagcactttgggaggccgaggcgggcggatcacaaggtcagaagatccagaccatcctggctaacacggtgaaaccccatctctactaaaaatacaaaaaattagccgggcgtggtggtgggtgcctgtagtcccagctactccgggcggctgaggcaggagaatggagtgaacccgggaggcggagcttgcagtgagccgagatcgcgccactgcactccaggctggggacagagcgagactccgtctcaaaaaaaaaaggtaaaagaatgaaacaatggctactccataggcagagcagccccaagggctgctggctgcccatttttactgttagttcttgatgatatgctaaacacggggtggattattcatgcctcccctttttagaccatataggataagttcctgacgttgccatggcattcctaaactgccatggctctggcgggagtgtagcagtgaggacaaccagaggtcaatctctttgccatcttggttttggtggtttttggccttttttattgcaacctgttttatgagcaagtcttcatcacctgtgtcttgtggcgacctcctagctcatcctgtgactgagaatgcctaatttactgggaatgcagcccaggaggtctcagccttattttacccagcccctattcaagatggagttgctctagttcaaacacctctgacaatcccacaaaatgagaactcagtcccacagactgtccccccacttcagacaccagtcacaagttcgggtcccccggacttctgacagcttcaagttggagtttccacaaccctctctttgggttccattaacttgctagagcagctcgcagaactcagggaaacctacttacatttgctggttcgttataaaggatattacagaggatacagatgaagagatgcacagggagaagtatgggaagaggcacggagcttccatgccctccccagcatgccaccctccagcaacctccatgtgttcagctatccagaactctccaaaccaggaattttgggtttttatggaagcttaattaggtcggcatgattgattaaaccactggccattggtgatcaacttaaccttcagccactccccctccctgaggttggggcatgggaaggaaagtcccaccctctaatgctaatgctgcctcagtctttgtggtgaccagccttcatcctggagctgccagccaccagtcaatcggtagcatacaaaaagacatcactttaaaaattctaaggatttgggccaggcgtggtggctcacgcctgtaatcccagcactttgggaggccaatgtgggtggatcacgaggtcaagagatcgaaaccattctgaccaacatggtgaaaccctatctctactaaaaatacaaaaattagctgggtgtggtggcacatgcctgtagtcgcagctacttggaaggctgaggcaggagaatcacttgaacctgggacgcagaggttgcagtgagccgagattgcgccactgtactccagcctggtgacctagcaagactccatctcaaaattaaaaaaaataaaaataaaaataaaaattctaaggattttagaagttgtacgccaggaatctggtataaaaccaaatataggccgagtgcagtggcttacgcctgtaatcccagcaagagactagcctgggcaacatggcaaaaccctatctctataaaaaatacaacaattaggcagttgtggtggcatgcgtctgtagtcccaactattcagaaggctgaggtaggagaatcgcttgagcccaggaggtggaggttgcagtgagctgagatcatgccaccgcactctagcctgagcaacagagccagaccctgtctcaaaatatatatatattttttttttcgttataaaggatattatatatatacacatatttcacaatatcacaaaaatatatctattttaaagtactgaacaaaaaaacgttgggaggatcagaactctgatattttctgctttaaactctgaaattagttcaaagattctggtgctatttcttgatgatatccatcgtgtgtgtgtgtgtgtgtgtgtgtgtgtgtgtaaaacacacacagcattggcagtcaagcaaacaggccaaggtagaaattgagaattctgagatctgtctaagtcaacctttattttctttatttggaaaataagaacaaaagtaacaaaaatacagcaaaattatgacaaataaatctgacatttaaaaaatccataacacttttaacatccacatctattctgaattacataactatggaatttcttatgttcttcatattattttgtaagatttatgtactgtctgcccaaaaaagtgtacactattatccccatttttgcagaggtgggagttagatatctagacattgaggatcttagctaaggacaacagctggtaagaggttgcatagttaaaaagtgttaccagaaaggggtctagatccagaccccaagagaatgttcttgtatctcgcacaagaattctaagtgaatccataaagtaaagtgaaagcaagtttattaagaaagtaaaggaatactggctcacgcctataatcccagcactttgggaggccgaggtgggtggatcacctgaggtcaggagtttgagaccagcctggccaacatggtgaaaccccgcctctgctaaaaatacaaaaattagccaggcatggtgacacagtcctgtaatcccagctactcaggaggctgaggcaggagaattgcttgaacttaggaggtggaggttgcagtgagctgagatcgcaccattgcactccagcctgggagtcagagcaagactccatctcaaaaaaaaaagaaagtaaaggaataaaagaatgactactccataggcagagcagcagtgtgggctgcccaactgattatacgtataactatttcttgattatatgctaaacaaggggtggattattcataagttttctggaaaaggggtgggtgattcctagaactgaggctttctcccctttttagaccatatatggcaacttcccgacattgccatggcatgtgtaaatagtcatggcactggtgggagtgtcttttagcatgctaatgcatcataattagtgtataatgagcagtgagggcgaccagagatcactctcatcgccatcttggttttggtggggtttggctggcttctttaccacatcctgtttttatcagcaaggtgtttgtaacctgtgtcttgtgccaacctcctgtctcatcctgtgactaagaatgcctaaccttctgggattgcagcccagtacgtctcagccttattatacccagctcctattcaagatggagtcgttctggtttgaatgcctctgataaatgcaaacccaggtccttctggctccaaaattcaatcaatgttgcctcttttcaaaatatttctatctgcttgggaaaattccagctgatttgccttaggggagaatttaggatcccctattagtcatggtcccctggggaaggaaggcatcttctccaacctggggctgcctgaggagaactcaccagtcaccaccaagacacactgactgcaatgcagccagccccctgacttttggaggaatcctggtgcttcttcccaccttgaatatgctctagcctaactgtctgcctggggcactagtgttcctgcatggcttcccgaccagccaggccttttccatgatttgcttcttttcttctctaaagtatccttgttactttttttgtttttagacagggtcttgctgtattgcacaggctggagtgcagtggctcaatcacagctcactgtagcctcgacctcccaggctgaagtgatcctcctgcctcagcctctcatgtagctgggactacaggcctgcaccatcatgtccagctaatttttgtaggggtttttttgagacagagtctcactctgttgcccaggctggagtacagtggtgctatcttggctcactgcaacctctgcctcccgagttcaagcgatcctcatgcctcagcctcccaagaagctgggactacaggcacatgccaccacacctggctaattttttgtattttttttttttttttttttttaggagagatggggttttaccatgttggccaggctggtctcaaactcctggcctcaagtgatctgccagcctcagccttccaaagtgctaggattacaggcatgagccaccatgcccggccaatttttgtatttttttgtagagatgaggttttgccgtgtcgcccaggctggtcttccttgttattttctaaggagactctaccttgctccagttctggcctgaccatcctcttcttgagtttcccatcctgatactccttttccttgggtgggtttgatgaagttacagcaattccaaccaaattagctgtctctccccttcttcaaatcttcataaagtaacacccccggcttctgcctacccttgcctggtctccccaggccatcctggctccaatgcagcaagctttctctggctcaacctttgtgctgggttaagatcctaatccgacctgttccttccctccttccaatacccaaaaatgttttggatgttttaataaatcaaatgaggagttatgaccttctgattaaagtttaataaatttatcaaagaactatgagaacattcagattaaaaaataatgaaatgtaaaataaaagcaataaagacgaataataaaatcaatagatattattctaacatcaagaagcaaattacaataagaaaattagattataccaaaggcaagaagtgattcattaagagaaagagaagggacacatttcaaatagaaatcatgttaagtaataaattattggattatttgataatccaatgagtgaatcataaaaatacataggaaaagatttaaatttcttgctgatgacaccaaatactggcatcaatgaagctaacataaaattcatactataccacgaaaatgaggacatgaatatcatcagttcaaagagtatttaagatagaaattcacgagaaaatctcaaatgccctgagatcttaacaggtctcctcagaaagaaagtagatagtggtttgccaaaatttgacaaatgctaaatattttcttggcattaccaatcataagttgtgaagctggaaaaaatttttataagctatcaataataaaaataaattttttatcaatcatgcttgataagattgaataatctttccattctctacacagaaaatcacacaaaattgctgtcatagaaaaacataatcaaaaagtatatagctaaaataaagtaaaaaatattttttaaatataggtgtccgatgatttgtatattgttacaatttctgttcttattctaaatactcacttttcataactaattttgcatgcttttacttatagaggcctccaaaaattgtctaaatttcagccctacaaaccctgaactcatcttcaatgggatattgcgtttctccctccccctctcctcacgcaaactcagggctgaccctctttcagacagacagacagtggccagaacagaaccagaacaagataagcggaaatcctacccactgtgttttttaccttaaaagtcagtaggattggctgggcgcagtcgctcaggcctgtaatcccagcactttgggaggccaaggcaggtggatcacgagacaggagagactagacgagaccatcctagctaacacagtgaaaccccgtctctactgaaaatacaaaaaattagccgggcgtggtggcgggctcctgtaatcccagctactcgggaggctgaggcagacaattgcttgaacccagaaggcggaggttgcagtgagctgagatcacgccactgcactccagcctgggcaacagagcaaaactctgtccccatcccaaaaaaaaaaaaaaaaaaaaaaaaaaattagccaggcgtggtggcgggggcctgtggtcccagctactcgggaggctgaggcaggagaatggcgggaacacgggaggcggagcttgcagtgagctgagatcgtgccactgcactccagcctgggcgacagagcgagactccgtctcaaaaaaaaagaaaaaaaaatgtctgtaggattgattcactagcaagtataaagcccatgaaaacgccaggtactcggggactcaagaactgttgtttttaccaaatcatattaactccaaacagacataacagctggatgaacatgttcaactttatcgttgtttttgttttaattattctcttttttgttggtggtggtagggggagagtctcattctgtcacccaggctggagtgcagtagcgcaatcacaactcactgcagcttcaaccttccgggctcaagcaatcctcctacctcaacctcccaactagctggaccacaggtgtgtgccaccacacccagctgactttttaaaaagtatttgtaaagatggggtctcactatattgcccaggctgctctcaacctcctaggctcaagtgatccgcccgccttgacctcccaaagtgctgggactacaggcatgagccaccctgcctagctgttttatttattctgtcttctcaaaagtaaatattttgctgacataaggtagcagagtaaacatggagctctccttccttgcctaatgaagcacaggtatcgaaatggatttacacacctgaggaagacctggcaatcctctcacaccaatttgcaggatggtatttatgtggactgtggtcacatttcttaaaaaaaaaaaaagctctttattgcttgaataagcatttgttgatacattagacaagctaaagccatttccatataactgtttcatatagaagttgttttatttcattatttccttgattcttatttgtccttcatgaggtctcaaagattgtctattatatttaatgaaatgtaaattgcaaagctttacaaaaactgtaattctagaaattatttcattgatgagtttttttgtatcaattcagcagacactggttgagaatcttctcgaagtatgacaggcactgaactgggccctggggaatgcagagatgacattcaggatgctttctgcaaacgtgggtcaaggtgataaatgctgcttcgatgattagatcaaagtgttgaaagaaacagagaggagggagcagttaatcctgcctgctccaatcgggggtgaaaataaaaagtagattcaaagtgtgttttgtggaccccaagggctccagagaggagtctccaggtgtctgctggggaagtggggagctgagaggcagggcttcagatctccaattattgttcacccaaagcacagctgcttccatctgttttatttgttggaaggtggcattagacttctctgacaaaaagccactgcttttgaaaaataattttttagagatgaggcctcactcttgcccaggcagctggagtgcagtggtgcagtaatctcactgcagcctcaacctcctggaatcaagtgatcctcccacctcagcctcccaagtagctgggattacagatgtgagccaccatgcctggctacaatattttgaaactactaaatgagatgtcctttggtgtgagctttaaggttatagaatttatccaaagcgagatgaaatccagtgccttcaactcccttctctatgttaaaattcccaaacctacatctttagccccaactgttctcctagcaccagtatcccccatcctcaatccatccttttctctccacaggacatgttttagaagattgatggctcccattgagtagtggataaaaatccaagctccctgtcatagtctataaaatccctcccaatctggctccaaatgtcttttaccatttattgtcctccacttacccaaagatgctgctgagagacaattctccatgggtctctcatttctgtacttcttgcaaaaagaagcactgaaaaattttattccaggctatcttttcaagaatgtttgtgtagtgaacagctttggaaaatagagacagtgattctctccagagcagagggaaggtttattcgctttctagtaaagatagtatctccctccaggaaaaggttcagtggatttgcttgccgcccattatacaacactggggtttcctacgtgtggggtttcttagctgtaacacaaacccactgggtacagcatccatctgggccgctgcattgctacagtggacttagaaggctagaaacccaatgcaaaaaggaatctcatcctgcttttttgtgtgagtaataaaaatcctttgtctctaactcagggatctcatgcatgcaagtaactgccgcaggctagcttgttagcttacatacaatgagaaatcccagacccttcatcttcacacagttctttttttttttttttttttgagacagggtttcactgttgcccaggctggagggcagtggcgcgatctcagctcgctgcaacccctacctcctgcactcaagtgatcctcccgcctcagcctcccaagtagctgtgactacaggcacgtgccaccatgcccagctaattttttgtattttttggtagagacagggttttgtccttttgcccaggctggtctccaacttctgggcttcaagtgatccacttgcctcggcctcccaaagggctaggattgtaggcatgagccaccacacttggtctccttcacagttcttgacaggtccctgtattggtcaggataaactaagtgtgctgcagtaacagcccccaaatctcagtggtttacaacacaggcaagtttcttgctcattcttcatgtcctttgcaggtcatctggtggccctgcttccatcaccattgtcctcactctagggcacaatctgacaaagcatccactctctggaacattgttaggggtcaaagaaaaagagaatgtggcaaagaatgtgcccacttttaaatctcccacctggaaatgagagacatcctcctgcttactttgattggccacatctaaattcaggtctattgaaaagtgcaaagctaccacatgcacagaaagaaggagagttggaatattgccaaacatccctaatgactcccagaacaacctggtctccatccacaccacatgcttggtctttatacaaacctgctgtgctcgttcatgcctgtgtaattccttcttcccaaaacacgcttcttctccctgaacgtttagcccttcccacacctcttattacatggataacccctactatttttcaacatccaactcaaatattacctcctttttgaaaactttctctgaccatccctcacccagaaaaacacctcacttccctaagattctgtaacactctctatatcaaagtactaacccattgcttcatactgggtcatgaatttgatgcctgccataaatcaagatcccttgagaatggatgataaggagtgggcccatgattttttaacctcctttaggcaaacctagcaccattttgattaaaatatttcagaggttttctactcgattaaaaaacaacaacaacaaatcattgccacaaccttcaaagcgcacacagactgaccatctccagcctcagttggtgccatgatccttctgctttcaagtcccacttcagtctctcaaacctgtataccttctctctccacgtctttgcatctgcctgaaaccccccatcctcccctctccctcacctcattaatctctcctcatccttcagatctgagcagggaagcatcacttccaggggagtgttcctgtcacccacccccccccgccctggtcaaatctccgcttgtctgttctcatagcactgtggacttctgcgtagccctcagcacagcaagtattctgtgggttttgtatgactattttactgtgttctccccacactcaaccttaaactacaagttcacaagggcatgaatcctatccatttttgcccactattggatccctagttcttagtatattgtctgtcacatagtaggactcggtagatatggacgagtaaatgagtgaatgaatgaatataataagatacccaatgtatgtgtcttggattgaagaatttcaagtagagaagacaacagttaaaaaaaaaaaaaggtacaaaagtttgtctggtctgcagggcaaattttttttatgaatgacaagagaagcacaggaggcaaatgaaattttacataaatcttccagtacttcatctcagtgtagaatctgaattatgaaagatcgactcagtagataccacattccaggagtttagagatataatctcattatttttcaacctttgtttctaggtgtaatttacacctaattttttttttttttttttttttgagatggagtcttgctctgtcgcccaggctggagtgcagtggcgcgatctcggctcactgcaagctccgcctcctgcgttcacgccattctcctgcctcagcctcccgagtagctgcgactacaggtgcccgccaccgtgcccggctaattttttttgtatttttagtagagacggggtttcaccgtggtctcgatctcctgacctcgtgatccacccgccttggcctcccaaagtgctgggattacaggcatgagccaccgcgcccggccacacctaatttttaaacaagcggagattcttctaagccagttgccattatcattatctaaaatgtatttgatttactatttacaaagcattttccttatgctatcatattaaacactaaacaacccttataatcaagattaaaagtaggtcataggctctaactctgacatcttcacagaataatttttgatatatttgtgaaataacgagatggcaggtaaggcggaaaagaagcctcccaaacaggcaagaagagtagatggcagaggcacagagaaggagatggagagacatggaaccaaaaggaggggtcacaagaggaagagtatcgtccaaaagtaatgtggggatgggctctgaagcagggaagagggcggcggtctttgaagttggcctcgatggtggtcttttttttttttttttttttttttttttttgagacagagtcttgctctgtcgcccaggctggagtgcagtggcgcgatctcggctcactgcaggctccgtcccccagggggttcacgccattctcctgcctcagccctccgagtagctgggactacaggcgcccgccacctcgcccggctaattttttgtatttttagtagagacggggtttcaccgtgttagccaggatggtctcgatctcctgatctcgtgatccgcccacctcggcctcccaaagtgctgggattacaggcgtgagccaccgcgccctgcccaggcccggctaatttttgtatttttagtagagacggggtttcactatgttggccaggctgttctcaaactcctgacctcaagtgattcaccctcctcagcctcccaaaatgctgggactacaggcgtgagtcaccatgcccagccctcagtggtggtctttgaggttggtatcacagattgtggggagggagacacataatgtgtggggtaggaaattcgtgagaatgtttagaggcagtaagtccctgaggcagggatgacataggagtctatagagacctgaacttgtcaacaggaaaataaaagatatttttaggtgtctgtgtcattaaaggacttctatgggtgggcgtgggccgtaaggtttgactaagagcagtaaaatggggagtaggtaacaggtcacagaaaatggaaatcggtcattactgtttgtttgagattccatcagtgtctggggctggttggtctcattggggaaaggagcatcttgagtgggaaggatgcccaggaaatccaaatagactagcaaagtagccaagaatacagaaatgccctcatcacctcaccaaagcccgtgtcccctcatgttgctctgggagggctgggccacccacaggagacttgcacaggttccggggaccccaagctgctggcagagccccccaccaagtcctgtccagcttctggggctctgtgagcagcatgagccaatcctcctcacacacatgcagagcctcagagaaggagcatcatcctccatcctgctgcccaggacaaaaacctggaaattctccttgacttttctcccactttactccccaagtctaataggctctaggtccttatatctcccaaatccactcacctcttgctatccccataaccactaacatagttctggaacccaccactgaagcgtgttctaacttcctcccgtctgtcttccttcctgtcactgaaaaactgatggcagtccttcctctgcttatacctcttcatcagctcccttccaccattagaataaggcccgaacttcctaacgttgcttcgatatccgcatgagctggcctctggtctcctctccggctctcaccaggcttccctgccagctttgtcccgccataccaaactacttccagtcccatacaagtgcctgtctccctttcactcctggactcagaaaattcatcttgctttctctggaaatcatcttaacctcacgccccttacccttggccccatcaggccagattccctgggttaattcctgttcttgagacttcggctgtgatgtttcctacttcacagctctttcggggctgggtgagcggccctaactttgtgctgccgtagccacttgcatttgccaaaaccagagcatatcatcctctgcatcatagtgggttttttttttcccacttatctgtctctccatctagatctgtggttctctactccctgtaaaataaattagagtcattgttttttaaaaaaaatgctaatgcctattaaacaaaaatctcttgaggtggatctgggcatcagagttttttaagtttcccccaaataattctagtgggcagccagcggtgggcgccactgagccagacggtctttgttgccagtgcacagggaacaatcctcagtgtctgttacacaaatgagtctctgatcattccactttggtctgcagggcaaaaactctacagagagggcatggagaggaagagatgggtcttgaagaagaaacttgcactagggaggacccacacctcccccctgactccagctccctctggtacaaaaccccaaagctgagctgtgggcccagccccacccacatgcaactctgcgctgttggaaaggcttggaagtcaaacagcaatctactcctcttcatggaggcaaggataaattttcttttcaaaacactttaaattttatcacctcttcagaacaagtacatgaatgaataaactgaggctccaagagactgtgagtggccctcgcctcaaatctctagagcaaggcagagcagaaatcaatacgtgactccccaggagcaattggcctcgtcctgggtggcctctgcgcccaccctaactctcctgcctcctagagcaggcagggctcgccccgaaccaccctgcctcctagtgctgacagaggcacatctgcagggtgaagaatctgcaggcaggatgcagagagtgggaggaggaggacaatttcgcacctgagtgatccttttcataaaaatgggatcacgttacttcctactaagagaagggaaatgttatccgagaatgtggggctctcattctcggatatgagaatgtctctgccaacaatgcctggcctgatcttacctaccccacttcaccaggggcactcacagctagaatctgctgagaaccctcaggctctcaatgggtgtgactcatctcttcctctattccctctctgtagaggttttgccctgcagaccaaagtagagcgatcagagactcatttgtgtaacaaacattaagggttgttccctgggcactggcaacaaaggccaacccggctggctctctgagctcaagaaatcacagcatggctcagcggtgctcattgctggctgcccactagaactatttgaagaaacataaaactctgatgcccagacccacctcaagggttttgttttgttttgtttgttttttgagacagagtcttgctctgtcacccaggctggagtgcagtggtgtcatctcagctcactacaacctctgcctcccaggttcaaggactcctcccacctcagcctcccaaatagctaggattacaggcacacaccaccatgcctggctaattttttgtatttttagtagagacaggatttcaccatgttggccaggctagtcttgaactcctgacctcaagtgatctgcccgccttggcctttcagagtgctgggattacaggtgtgagctaccgcacccagccaagagattgtttaatcagcaaaaggctgggcagggcagtggggcctagggcggcacttgctatcagatgtctggagggcagggttggctttggccatagatggacctcggttcaaatcctggctggccataccacttaccagctctagacctagagcaggttaacatcatgaatctaaactacttaccacttaacaaagtgagtgactatctataactgttgccgttgttacaagaaatccacttagtaactgcactgaaagcccctcatccccaaaaggcaagaaatggggaacaaccgggtgactaaggaaaactgcaagtgaaagcagctgtaatttctctcgctgtggtttgcggtgctcaacactcttgcttggctggttgtcttggagggttaatgaggtctctgctgagtgtcctcagcttagcaatgggcagtggggctctgttcacagtctcatcccggccacgtggcctcccgggttcagacaccctaggctgatgctgtggttccatgtgcctgaacacgagcatccgaactcatttccggcctgcctgtccccccatgcaacggctcctgaaaaaggggaaccaaatgctgcccatttcacccccatcaatagctgacaacgcctgggttcctgctctcctgacattcccactcattgtcgtcagtggagcgagcaggcagaggggaagtgagctgcctatcagcccctgcaatcagaaaaagagccgggtgcctttaagacgaaggtggtgggcagccatccatcttccctaaacacacactcgccttgttcttccatttctggctgagtgataaaaacgttaaatgtcatttcctgtatcagtggttaaccactagatgctggatcagagatttaccagaagtgctgaagttatggaaaaaaaataaataaacctgctgttttcaataaccctttcttgcaccctgtgggaactatgtaacctctggggagggggctgcgagggggtcgctggatttgacttgggcaacacacttaggactagatttaccaaatgctttcttatgcttcatataggaagtgaagagagacaaaatgtaaccatcctatacctgtccccaagtgcgcgtgtgtgtgtgtgtgtgtgtgtgtgtgtgtgtgtgtgtgtgtgtgtagaaacgctgggaaaagcaggaggaaaaatcatccacgtgccttctttgcccacctctctcaggatatcttgcagtcattttggttttattgacccagggtttttgcagaggacagttgccctgactattcgattccctcagcttcctgcaacaatcaatgtcctccagtgacaagaaggcttcctgggggaaaacatgctcccaggaaactcctgagaggtggagagcccagctcaatcctttgttgtgtcctcttcttctttcagttgctccattaaattaatcaagagctcagaaaagggaaggcctggcttagcccccaaggagaggtgactggaccgactgcagcctgcccacagctgtactccaagcccagccatgcgcttctgacctgaggtcaactccccacatacagctgccctgggctcctccctgcggcctcccaggcactcccctcagtctggacatataagacttaggagctgcactttgttctagcaattccatttccttcccagtgccagttgggatgtgctgtgcacaccaagtgcccctagctcctcacctacctctgggatcactgacagtcctgctttacctgggaccgaagggattcatggggcggccggggcgggggagggaggacttttgtttctaaaactgggaaagtcccaggcaaaccgaaatgaattggtcacccccgcaacagatacaatggtttgcataggcacttgcacgttctatgtcagaacggtggccaagaaataaaaaataataaatatgatttaaaaaccagaaaataatttttaaaaaatttaataaacataagataatttttttaataaaattaaaaaaaaaaagaaactggccaaacttgagaacagatctagccagggtactgagaactgcagacggcattgcatggtataagagttccctggggagataggacggagcgcatcacagatctcccactgcacctggcgcatacctagaagtcatcctctctcaattcaatagttactagaggagatctgaaatcaaagtcagaatcagaagggaaaagagcatgggaaaacgtacattccactaaatctcttgtaggcctctgaaactgaaacttctttttccttcctcgcgcccttgagtaccaacaccatcagcccccctggtgcccaggacacaaagattcgagagatgcattgctctttactctgcctcgctcccacttcattttattattatacctagacctgatttcctgccacctaggatctctcctctccacttccacttctatgactatccttccgctgtctctgccctcaaagactggcctccatcctctccaacctcaatttcatctgctccctggcatgttagatgctccctactttttcaaattatattcgagaagtgtttattgaatacctagatcagaaggatgccagagaggtcgcacccggatttcatatggcattggacatttctcatggatgcctttttgaatgacaccatctgtaacatcttactgactgagaaaacctcctggacactgccagcaaagctgggcatggcctcccttgcttcctggtgcaaattgccacttagccctcattacattgctatgacgactactttctgtttccatcttgtctaccagctgcgaaccccagtgtcttatttaccctgttttcccaggtcaatcccagaccttgacagatagtggccattaaatacatgtagaaaagaagatggtctggagatgaaagggggaaatattgggtggatgctattatacttcaatgggtctgtagccatttgaacatatacatttcaaaggctattgattatggttggatcaacctggaagatgatccctattagagaaccaaaggtctcagccctgggccctatcctaatgtttttacaaacttcctggataaagattaaaaaggtacccaaaacagatttacagataaaaccaaagctgggaagtatcactaatatgtagaatgctagaattcatgttccaaaattgtcttggcttatgagatggatagaccaaaactaagaaggtaaaaatacacacccaattagtgtaaaggctacactcgtagtagcaccatcactagcacaatgaggaagatgtggttcagcagcagttcgggtgaaaaactcctagcaattcctagtctttgagctagaagagaacgtagaggactatccaatacagagagtctcaagctcttttcaaacaataacattcatcaagtggaatttcatgcagaggccctgtaggtaaaagaatttttttttttttggggatgaagtcttgttctgtcgcccaggctggagtgcagtggcatgatctcagctcactgcaacttctgcctcccaggttcaagcgattctcatgtctcagtctccccagtagctgggattacaggtgcatgccaccatgcctggccaatttttgtatttttagtagagacggggtttcaccatgttggccgggctggtctccagctggctggtctcgagctcctgaccttgtgatccgcctgcttcggcctcccaaagtgctgggattacaggcatgagccaccgtggccagccggtaaaagaaattttttaaaggtgctgctctggttaggagtaagggaaaggggtctaacaagtcagcctccaaccaattcgcccctccctgctatcttatgaagacccctgaggcaccctcccaaactcctggggctcttctgagtgaacactgtttgaaaacacagacctgagtcaatccccttgctctacacagctgcccatctggtgagtgtcagaattcccccgaaccctctaatccctcagccggctttattttgtgttgcatttcatttttctttatagtttttggccctccatggcactgtatgctgcacttcactctgtgcaccgcctggctgtctcactggagtcctgctgtcttttttccaccagtgcatccctgctgcacggaacacagtgggaggaagatttaatgggaaaggaatgaatgaactggaaaggaacccaggtatcttgacacccacccaacttgccctcccagtagtgtaactgtccccaacaacaaccaaagccaagatcacattaggctgcattaggagatcaaatgggcccaccgtactcatcatggttcaagccttgtctggaatagtgtgttagattctagcagctacattaaaggaaacaaatgtggcagaagtggcatataaataatattattgagggatgactttgtgccagacatactgtacattcatctcatctagtcatgacaattatgctgtaaagtaattattatcctccttttgaatctggggaaacagaggctcagcacgtttcagtaatttctccaaaggcctaggattcaaacccctggcaaagcttgggttctatccaccacaccgaggtgtctcttggaggggcccccaaaagggcaagaagagtatggaggatctagaaatcatgaccagtgaggccagatatggtggctcatgcttgtaatcccagcactctgggaggccaaggtgcaaggatccctttgagcccaagagtttgagaccaacctaagcaacataggaagactctgtctctgcaaaaaaaaattttaattcgccaggtgtggtggcatgtgcctgtagttccagctcttcaggaggctgaggtgggaggatcgcttgagctcaagagttggaggctgcagtgagccatgatcatgccactgcactccagcctgggtgacagagcaagatcatgtctcaaaaaaaaaaaaaagagagcgagagaaagaaatcacgacaaatgagacatttagcctggagagaatcagacatacatgacaggctgggtggggagtgaggagaccatgacagcagtcactgaagaaagaagagcactttttgaggagggaaagtgctgagactcaaggccccttgtcaggtgaggtgtagaggagattcccagatcggtaggaaagtggcccaagaaactctgggctgtgttttggccttgctgcacatttgtgggtggagacaattccctgtgcccaccacacacccacaccatcctctatcaccacatcttctgtgccacaggctctcccgagctgtctgcctgtttattttcctgtgacgagagggaccaagcagcagcagcagcagcggcatcataataactgcccacaagttgtagttggaataattttcagaatggctcgagctctatggttaaagaaacgactgctggtggagtgtagtaaacaggccccagccacagaacacagcaagtgggcacaggacatgggagtccaagagcaaggcccgggtccaggacgcagcagggctgggaggagctgaccacaggaccccactccccgcagggcagcacttcatccagggcccttccctggctgcgtaactgcccagattcgtgtctcctgatctgttgtaacacacaaaggcatagagcagaacaggaaactcaggaaaaaaaaaatggtcttttccctcttgagtgtctgctctgataaagacccttcccagaggctggtccttgtctcaagcccactagaaattctgccatgagtgtgagttttagagacactggggaaaatagaatacacaccagcagccatctcgctcttggttgatcaaaatagaatcataatagttctctcttccctgtccagaatcaccttcttcccatttttctgtgccccctgccgagaaaccaaccaagacaaggggtcagaagaagcactgagaaaccactggagaattcacaaggatagtcaaggttgacagggtccatggaaagacccctaaaagtaccctgtctagaatgtgagagctgcaagggcctgcagagtcatctagtctgactgtaaatatattcaactgcgggccatatgcggtctccgtcacaaccactcaacaaaagcagccatagacaatacataatacaatggccatggctgtgttctaatcaaacttgacttatggttatcaaaatgtgaatttcatataattttcatacattatgaaaacattactctccttctcaattatttaaaaaggtaaaaggcattctcagtccactggccggacgaaaacaggcagtgggctcaatttagcgtgtgggccacagtttgtcaattcctgatctagtccaagcccttcctgagacagaggagaaatctgactcctaggaaaggcagcgactggtggttcagtgtaggattcccatccacacacagtattccattcttgtgctgggctcttgcccatgcaaagtgatatttcagctgccctcatttcccttgggcatgatgtgcctgtactgtgagggcagcagcctggtctaagccctgccaactgtaacatctggaatggaacttcaggacttgacagactctgactctgtcccatttctgcactcactcccaggatgaccttgggcaggtccatcaccctctcttgatcccatcagaaactgcagacatgggaaccacacgggtcatctctgagagtgggtcttcagtcattgtcctgccttcccctctcctgggatcagtaccagcaggcccctggcatcttctccagcagccatctctcggagcaaccagttctgaggccaccaaagtatagtgacttctgggcaggaaaactagggatggaagcaaatgagttgtctgttttcatgcagatgaagtcgtgggaggacgtatgattcatgtgttgagtgctttttcaatagcatgtttctatcatttctggaagacagcaagttagtttccccccgaggtggtgggagaggatgttgtttgtggttttcccttttagaggggagttacatttgtttttgttgttgctttgttggtttatcaatttttttgttttgctgtgttgtgatttgtgttcatgaggagttggagatggcggttgggagagaaagttttggaggggtaggaggaagcagagcctatgtacaatgtctacaggggctgatcacacaaacaaggtcaaggtggttcaaagtcatagtcagatgcctgggggcctgccaaacaccacatgccttggttaggaaattagtgacagtttgacatctgggtcttgtgtgattgccatccaaagataaggaagggaaagaggagagtcctggcatggagttccaagcaggctcagagccccgggcctgcctttccatcacattaaagaatgtggctgctgtgccctggagcggttccctagtcacaccaggtgatgggagccaggagcatgggatagaaggagcctggtcactgtccagcccagagtatcgctcagtgttggctcccctgccagtctcttccagggtatctgacacccaaacaggttggtgcctggaattagggtattaggccactggaccttcttggggagctctagggggtctctgggaacttgaataagagctgctccaaaaacttctctgaatcctgcacccctcccttagcaagcagtatgctggtaaaaggttaacaaccaagtatctggcgaaaaaatgccctgattcatagcatttgctaactcccatggtgtaaatactctcctaccttggccaatttcaagtggccagtgttatgttaactagatcacaaaaatcctgaaaattaacattgagttttctcaagccagaatgagcccctcttctacaccacagccctgagccctctggaaccaaaggagaactcagaaatcaggaatcatttggtcccaggctttccaggtgccagaatgaaccacgagctcccggtgaagccgcaagttttatgagtctgcagcacctcacagtggagggaccctggtgggggcaggaggaaggaacggaagttggctaattagagaccctaaaaagcccccagagaatgcaagtaagagagaaaaagggattgggagtaaatgctaggaactcaagcattcaaacctctgtgtggtccacaaaacaaaaactgtgaggtatttaaccacctctccttcttatttcctgagtgtgttcctgtctcagtccatcattttccagagaaaatcttcctaaaggatgttaggaagcagctgtccatcccatatccctgagaaggggtgccctgcccctgcaacgtactaaacacaaggtggtggctgacatggaggaatctgtcccctacacacataggaccactctgccagccaggcccaggtagcacctgggatgaactcccctcaccctgctccctggtcctctccctactaagtcccatctaacacactcctgcttggctaagggaggaaaatcgcacctcctccaactcctctgatgtccctacagtccatccaaactcacttacaagagtaaggattcttggatcgacacaggccccttcccttgggcagtttcggcttagcaggcgttctgggaagacagccaagcagtaactcacttatgaaagacttcattctgtgcctgctctcctcacccaacagctgacacacatggacccccctcgctgccattttagtggccctggctggtcagaacctactcacctggcccgagaggcccacagtgtcctgcctccactccctttcctagagccctggattccattcctacctctgccgctaattgcctcgaacactcatttaatctcttctgactatggtttccttatctggaacacacaaatggttggacttcaataatattccatacaagttttatagaaaaataagatttgtttggaactttaaagcgatcaagtattttcacttaattattacaaaaagtatgtgatataagtagtaatattagataatattaggaactgaggctcagagagcctgggaaatgcattccagattacctggataagaggtagcccacccaaactcgatctcattcctctgacagccaacactgcacacagacacctgagcaagttgctacaactgggatcccacagcagagtcccacagctgttcctcagttagcattcatgtccctttgattcaccagtttaacacaataaattccgttcattctaggctgagagactaacgtgaatacgctcaatgtccaggagaaaactagggtctgtcctgagcaaagttggtgagtgagcgccatttaccttccctgagccccccaaccttctgtgcacaattctatgtcctatacctttgcctttgcaatctaacattcttccttgtctttttttttttttttttttttttttctgttagagtcagggtctcttgttccgtcaccaaggctggagtgcagtggcacaatcatggcttactgcagcctcatactcctgggctcaagcgatcctcttgcctcagcctcccaagttgaggactacaggcatgagccactgcatctggcacctttcttgtcttaatactgttctagtccatccaaaacaacaacaacaacagcaacaacatttcaatcaaagaaacatacaatactgcctccccacctcctgcaataaaacaagtgctgacacccaccttccacaaaagaggagaaagggaccctttcacccgacatgagggtttctttcacttttttctttctttttttttttttttggtggggtgacaggctctcactctgtcgcccaggctggagtgcagtggtaaaatcacagctcactgtagcctcaaccttctgggtcaagcgatcctccctgagcctcggcctcctgagtagccaggactgcaggagcacaccaccaccattcattagcggccctgcctgactaatttttttattttttatagagatatggtctcattatgttgctcaggctgaactcaaactcctggattcaagcaatccactcgcctcagcctcccaaagtgctgggattataggtatgagtcaccgcgcctggcctatttcacatagttctcgcccttagtcctatgctgccctgtctaccttggggcagaatttttccatctgccccaagcgctgtattcttataaccatcctgtctctttatttattgtatgtcctggatgccagcgaggcccccctctacacacacactcaagaaggttaaggcaagaggaagaaacaaaaagagggacaatttactgccctttacatagcactttgtcataacaatacccttccaaagccctcactgaacggtgagaacaatccaatgaagtaggttttgttatgtctgtttttacagaaaaggacactgaggctcaaagactttgtaggtcattcacctcgtaagtagaagagccagaatgggaatccatgttcatctgactccaaaggcaatggaatggccaggcccctccctaggaaattatctaataggactcttcaaggatatttgccttttaacaggagtgtcttgaagccagggtctcacaaaccaggcaacagagctcgaagcggtcatacccaatacctgctgatgcaatcatatggacccaatgggtttgaagcggggtgatctcttactgcaccaattaaatagtcatcagttctaccaaccataaaaccaaccataaatgtaaacaaagaattcctgatcccacgggtctggacactaaaagtgtccccaaacttagagaagttctggaaaagaacatatcaaaattttggctttgctccagatgctataggaaactgtacgtcacaagagttctccattattgcccagacaatggaaatagcaaccacgcagcaccttctaaaatcccttgcagtctgagacgtgtggtggagaccctggttttcattcattatgcatgaacccaaagtacagacttgcagaccttcctagaaatgagtagtaagttcagaccatcagaatattcagaaacctgatgtatttcagagactttagcagtaaaaaggggtcagaacactagaatagctgtctggtgaaatctaggagctttgttcataaagacattatgattcagttaatgagatttggcaaggtattaaccatcttggtagaccaataatggttggctgctatggagtttagactgggaaatagaaaactgaactgttatcagaaaagtttgagatactttcctatactttttgtataagatgaaagcctgcaaaagatgaggctcaaaagatatggagacaacctaaatgtccatcaatggatgaatggataaagaaaatgtaaaatatatatatatatatatatatatatacacacacacacacacatatatacaatggagtattattcagcgttaaagggccgggggcaggatcctgtcatttgcaacatggatgaacctggaggacattatgctaagtgaaataagcctgattcagaaagacaaatactgcatgatctgacttatgcaaaaaatctaaaataatcaaactcacagaagcagagagcagaacagtggttgccagggggtaatagggagggaaaatggggagatgttggtcaaaaggtaaaaagttttagttatgcaagatgaataatttctggaggtctatcgtacagcacggtgactatagttaataatactgtattgtacacttgaaacttgctaagaggtaagatcttaagtactcccatcacaaaataagagaaaatgactactatgtgaggtgatagagatgttaatagcttgactgtgtgatcatttaatcatgtatacatatctcaaaacatcggttgtacaccttaactacatacaatttctatttgtcaattatactccaataagagttgggggaaatggaaaaagatgagcttccataaatcatctgagcatatcaggaagtgaaacatgcaggtgttgagaataaaaacataattatctgctgggcgaggtggctcacgtcttgaatcctagcactttgggaggccgaggcaggtagatcacctgaggttaggagtttgagaccatcctgggcaacatggtgaaaccctgtctctactaaaaatacaaaaattagccgggcgtggtggcatgtgcctgtagtcccagctacttgggaggctgaggcaggagaatcgcttgaacctgggaggtggatgttgcagtgagccaagattacaccactgcactccagcctgggcgacagagcgagacagagagaaaaataatactaataaaataaaattaataataaaataaaaccgtaattacctagtgtgtggcctttcctggagaaaggctctgcacactgcccaagagcaggccttaatgccatgagctgaaccagcggggctggactcaagggttcaagggtgcggagtgagaggagaaacaacaaagggaaactggggacagctgctctggtgaactcaaggaagccacctgagatggggagggaaggaaaagggggttagtagagcttcagggaaacgcagaggagaagactgatttcacccggtgatagaaacaaaggaaaagggaaaacagaagccacgttgtggtggtcagtgctgcaagaaggactctaggagagatagcttctaatgagaagaggaaccggggccagcaagactggctccaggaggaaagttctgtgaggtccatgaaagaggaagtagggaggaatcgctgttgaaattctcattgtgaatggatggatcccaagtcctggaggaatgggcagaaaacagaaagcaaagaaaaagaaatgtaaaagaaggcttcaaagcctaattaaagtcatataaagaggataaagagtaattcaaagaagcaatgtgagaaaagaaacactaaaaagaagacaagaggaccctagggaaggaaaaactgggtgtacatttgtgtaagaaatctaggtattacctgtttgaagcagtttattcaccaggaactaggaaaggaactggctctgtggatttccttaccagacaattttcagagtgagatttttgtttacagtttattataagaaccttccaaagacttatgggatctggatctgatgatacataacaatgcttatgacctaaaaaagcaaaacgattcacttcatggaaatgcatgttccccgaaagaaatccatagagccccctaatgaaattttcaagagaaaagctatgtacaaacatatgatccgcttcctaaacgccacaagaaaggtacaggtggaaggagtagaggaagatttccacggattcttgagaaaaaaatgaaatgggaaatctaagacgagtgcccaacaaaccaaataatgcaggtttcaagagcacagaactgaatggggtttatttaaacacacataccagctgctgccacatggctaccaaatggaaactgagccaggagggtggcccagtttctaggtacaagaaagaacagaggttgtgacgcaacaggaatgatgtttccatttgtattttatgaagttaacagccaaaattcacctctgaaaacctaagtttggcagtggtataaagaagggaggaaattcctgatggaacaagaagggattaaaaacaaaagaggggagatcagcgggagggcaggcctctgatcttccctggctggcagtggtggacaagtaggaaaatgatgtgagcagatgctcaaggaaagtggccctgaaatcaaaggctttgaagagataagcagagtccctcaagcaaagcaataaacagagaaaccaggatgaatacattggaatcgaaatgatgaaatgtaaagtaccacagagaggtttctagaaaagcatccagagatggaaatggggaaaagagaaagatacagcagaaataaattgcatacgagattctagtgtgtgctagaaatgtagggaggaaagagtgatgataaaattaaaagaaagaagtggatagatcttagtggcatgattgaaatggataatgaaagggatctttatgaaactgttgccaggagaaggaaagatatagaaagcgaaaaaaaggctgtaggttaattccagtatgacaagaataacaaagaaatgcatgaattctcagccaacagcccgtatcaagagacaagcatgttctggctgtgtgtgaagggcacaccatgccaggggctctccctgccaacgcctgcagacttttgctcctcacctggacctcacagcgcacctgttttcaatgacacatggcggaaaagggtcaaaagatgaataaggccaggcgcagtggctcacgcctgtaatcccaacactttgggaggccaaggcgagtgaatcacttgtggccagaagtttgagaccagcctggccaaaatagcaaaaccctgtctctgctaaagatacacaaaattagccaggtatcgtggcacacacctgtataataccagctactgaggctgaggcacgagaatcacttgaacctgggaggcagaggttgcagtgagctgagatcgcaccactgcactccagcctgggtgaaagaagtgagactctgtctcaaaaaaaaaaaaaaaaaggataaaatgatactcatttcttccttggtcccatcgacaaacatttatcaagagatgtctacgtgccaagcacggtgcttgatactgagaaaatacaataattgataagcaacatagatattctgacaaaaatggaagcaaaaaggggaggaggtctaaaatatagaattttccagataagacagagcaaagttcaaagccgtgaaaatgagagtcaatgtgaaatatgacagaaatggggacaccaaggtggacacaagatgaccgtatattctcctcgaaggggaacaagataggaaaggaaagtgggaaacaaaaagtggaagtaacgtcaagagcccctaatggggctctaataggctctaacctgagtcctagcccttactcagctggttcccagatgatcttgagcaaagtgcttctgtgctctgagcctcagttcccttaactataaaataaactaatgatgtctggtctaacttgtggttgtcaccacgacacagtaaggggtattggttgtgccctcctgccataaacaacaataaaactggacgaattatatgaaactgttttcaggtgcaacgctacagatggtgcagggatgtgatgcttgagagaagaaacacaagaggtgaaacccacatttactctggcctcctgcctggggctttccaaccacagcacgcggaagtggagcccaaactgaggatggaggaaagagaccgaaggttagggctgctgcagggattgagtgtgtgggacagggtacgagagaggcaggagctgcacagagcagaaatccaaaaatctgcagaggagaccacctgaatctagttgaaaacaaaactgcacatgtacagggtaatgttttcacaaagcctagtagagaataggtagcaggggcaaggtgcagtagctcatgcctgtaatcccagcatcttaggagaggctgaggcaagaggatcgcttgagcccaggagttcaaaaccagcctgggcaatatagcaagacctcatctctacaaaaaattttaaaaattagctaggtgtggtggcatgcacctatagttccagctacttgggaggctgtggcaggaggatcccttgagcccaggagcttcaggctacagtgagctaagattgtgctgctgcactccagcctgggtgacagagtgagaccctgtttcttaaaaaaagaaaaaaaagagagagagagagagaataggtagtaggagctgtgcactgaacagagattccagaggtcacatggtgggaagagacactgtgttctcagtgtccatggtggaaagagcttgatgaacagcctgggctttcaacagaggcccgggaaaggccacacctgtggagctgggccaccccagcactagagagaggctgcactggacccatcaaaacaaagccaaattacaacactcaataatggatccaagcggatccaccaataaattaaccacctgccaaaacaaatgcaatgatccttacaggaagataataaaaccataatgtttgacatgtaataaaaaattactcaatgtgtaacaaggaggaaacaagtagtatagaaagcagccaatagaaagaatcccagaggtgatacagatggaattagcaaagaaaaactttaaaatgactaaatatattgaagaatttaaagggaaaaagtggacataaggaatgaaaaacagttactcattggaaaatagacattatgaaaagaaacaagatgaaaatcatgggactcaaaaatctacaataactgcctgggcacggtggctcacacctgtaatcccaacactttgggaggcccagccgggcagatcattgaggccaggagttcaagaccagcctggccaacatggtgaaactgtgtctctactgaaaatcaagaaaaaaaaaaaagaactgggcgtggtggtggaagcccgtaatcccagctactagggaggctgaggcaggagaatcgtttgaatccgggaggcagaggttgcagtgagccgagattgcaccactgcactccagcctgggcagcagagcaagattctgtctaaaaaatatgtttatatatgtatctaaaataactgaaataagtcacaagatgggcttaacagaagattagacactgcaaaagaaaagattagtagacatgaagacagaataataaaaattatccaagctgatgcacacagagcaaaaaaggactagaataaaagaatagagcttgagttacacatatgggatattattaaccagtctaacagatacataactgtagtctcagtaggaaagcaaagaggaattggggcagaagaaatatttcaaaaaataatgacctcctaatgtgacaaaaaagtaccaatccactgatccaagaatctcaatgtatcttaaacaagataaacacaaagaaaaccacatttaagcacatcatagccaaacgttgtaaaacaatgatgaagaaaagatctcaaaagaattcaggggacaaaaaaaaaaatcccacctgactacagtggtgcaataatgagaattatcactgacatctcaccagaaatgttgcaatcctgaagataacagaatcccatctttgaagttctaaaagaaaaaaaactgctaacttagaattctacatccagtggaaatatccttcaaaaatgaaggcaaaatgaataaataaaagctgagataacttatcaccagcacaactgcacaatgaaaaatattaaagaaagttcctcaagccaaagggaaatgataccagatagaaacagaactataatacacacaggaatgtgccagaaatggtaaatctatggggtcactatagaacacttttattttttaatttctttaaactacattgtctgcttaaagcaaaaatgaagtctcactaattcaagtcagactgtgctcagctaaggaactgaaataaaagagttgtaggtcagaagtcaatagaggaaagagaatactcacaagcacttcattaacccaaaaagaggcaggagagtcggggagaaggaacaaagaatagatgggaaaatctagaacaaatagcaagatggtagaattagatgcaacctaactcaatgctatggtgaatgaaatgaaaccatggcaatggaactctggtatagctgccctcatcacacgtgaggctctggctgtgcgtttctgggtgaaggggaggaaggtgacgaggaaggaagtagaaaagcaaacttatgggacatagaaattctaataaaataggttctaggtgctcaagcctagagacatgcttctaagtccaactactcactgtgaatacctggtggaaagatgacaccctttccaccagggtggatgacgtcaagcagacccaccaataaactaaccacctgccaaaacaaatgcaatgctctttaaaggaagacaataaagcccataatgtttagcatgtaataaaaaattactcggcctggcgcagtggctcacacctgtaatcccagcactttgggaggctgaagcaggtggatcacctgaggtcaggagttcgagaccagcctggccaacatggaaaaaccccgtctctactaaaaatacaaaaaattacttgggtgtggtggcatgtgcctgtaatcccagctactcaggaggctgaggcaggagaatcgcttgaaaccgggaggcgaaggtggcagtgagctgagatcgcgccactgcgctccagcctgggcaacaagagcaagactccaactcaaaaaaaaaaaaaaaaattactcaatatgtaacaaggaggaaacaaaagcagtcaacagaaagagttccagaggcgatacagatggaattccaccaggaaaactagaaaaaggctctgtctacagaagggacagtgtaaacagaatggcagaagagagcagaaacagaggatctagaaagaagaagtataatccaacgctgacatagggaggagggaactgtaaaattagaatctgacaaggttttaataggcaataggcaacgatcaattaaaacagggctgtcatgatacgtctggacagactcagttatttgacccatgaaggttctggagatgaaggcactgcaacaccaggtctaaatgtgtcatcccaaacatttgtagctaagtggcagagagaaatgaccaagaatgattcagttcagttcggcactcgtttactggggaccttctgacaccaggctctgtgtcaggtacagaggatataaaaattactaagaccaagtccatgcctttaaggggaaacccagttctactgggggaaacaggcatggcaacacatcagaaagtagtgtgtccaagcatccacctgtcacttaccagctgagagagtctggatatgtgccctgcccaaatctcatgttggattgtaatcccccgtgttgaaggtggggcctggtgggaggtgactgacccacgggagtggatttctcattaatggtttagccccaaccccaggatgctgtccttacgaaagtgagttcattctcatgagatctggtcgtttcaaagtgtctggcacctccccctcccttgctcctgttttgccacgtgatatgcctgcttcgactttgcactccaccacgattggaagcttccttaggcctccccagaagcagatgctgctatgcttcctgtatagcctgcagaaccatgaaccaataatacctcttttcttataaattactcagtctccggtatttctttgtagcagtgcaagaatggcctagcacaccagctatgtggctttgcacaaatcctttaacctcagtttcatcatccataaaatgaggataataataaccacctagcaagactaatgtgaacattctagaaataattttaaaagtgcctagctcaccacctggcctatagtaattcagcagctctcaacttgagaacaagacacacattagaatctaggtggcaaaaggagggtatttctaactagtcccagcctacctcccactcatatcctgattcccctggaaggatgtgcctacctattctaaacccattaccctggatgaagaaacactatgtctcatgcacgatataaagtgtgggagtgtgttttgcatgtgaatgatgcataggtagaataaagtttgagaatcactctgtaagcattcatctcagttcaacacttataaagcacctactgtgtgccaggctcataaaaaaactagtttggattatttccacataatgatagaggtatgtataaaatcctaagagaatataatacaggagaaggcactcagcctggggggtcaggaaggcccacaagccttggcagttacccggactagcaaaggtgagaagatcatctcaggggaatagaaaggtataagttggcaatagcatggtgtgtgcaaggaactaggatccaagcatcaaacagggtcaaggaattaaatatttgggagaggcagacaagcgcaagtttatgaaagacatgcaaagaaacctacttaatcctgtgggtggtgagagccacagaagagcatgatgaaaaggagacccaggctcctctgtgctccaggtcagtatctctgaaagcagttcccaagctaaatgtcatgatgaaagcacaaggagcctcagagagctcagcctgcagaggaattcattcctcaggggcagtgtgcactgctcactcaactttgcttctccagcacccacccaagtctgaccccactggaggcactaggttcattgtacagaactgatattaataaacttccttatccagaacttgtgcaatagccgagcatagtggctcaggcctgtaattccaacactttgggaggccacggcaggcagattgcttgagcccaggagttcgagaccagcctgggcaacatggtgaaggcccatctctacagaactacaaaaattagccaggagtggtggtgcacgcctgtggtcccagctactaaggaggctgaggtgggaggatctcttcagtctaggaagtcgaggctgcagtgagccatgattgcaacactgcactccagcctgggcaaaagagtgagaccctgtctccaataaaaaaaaaaacaaaacaaaaaagagaacctgtgcattttaacattatctccaactatggaattcattcaatcaccaacttttattaaccatcaagcagggagggaagatatgaacagaaatacagtcagggctttacgacagggatacatctgggaaatgcatcattaggcagttttgttgtgtgaacatgatagagtgcactcacagaatcctagatggtacagcctacagcctacaacacaaacaggctacggtgtatagcccattgctccttggctacaaacctgtacagcaagtaactgtactgaatatcatagccacttgtaacacaatggtatttgggtatctaaacaaacctcacgtgaaaaaggtacagtataaaagattaaaaatgggctgggcgtggtggctcatgcctgtaatcccagcactttgggaggccaaggtgggcggatcacgaggtcaggagatcgagaccatcctggctaacacagtgaaaccccgtctctactgaaaatacaaaaaattagccgggcatggtggcaggcgcctgtagtcccagctactcaagaggctaaggcaggagaatggcatgaacccgggaggcggagcttgcagtgagccaagactgggccactgtactccagcctgggcgacagagcgagactccatctcaaaaaaaaaaaaaaaaaaaagattaaaaatggtacacctgtatagggcacttaccaaaatggctgttgcagaactcgaagttactctcggtgagtcagtgagtgagtggtgagtgaatgtgaaggactgggatattattgtccactactgtagactttataaacacagtacacttaggctacactgtttatttttaaaataaagtaattgagctacaacatgacaatggctacagcgtcactaggtgataggaatttttcagccccattataatcttatgggaccaccttcatacatacagtcggtttttgactgaaacatcattacattcagcacgtgaatgtaattgcgatgaagtgaaagataaaggttatagttctagtgtatccacagtgctttaggagatgaactgttagggaaagccagaaaaatctccaccacggaaaaaatatttggcctgcgtcttgaaggataaataggaagtcagtactcagacaggtgccagtgtttttcagcctgaggcagggaggtatgagagacagctggaagggtttgagaatgggtggtgagaacttacacttactggggactggatataagaatgcagtaagacgtggacctagcaccgtgatttttcgacctgggctacacatcagaaacacctagcgagcttttaaatcttccagggcccaaaccacattgtgaaccaattaaatcaggacgtctggggctagaagccagtcatcagtatctttttttaagctcccaaagtgattccaatgtgctgccaagtctcagaaccactagtctagaaaggagggataaggattttcagcagcccccacagaaccggccctcctggtgaccctgcaatcctggcacacacaccccaccccgcctgggagaaagaccggccacaccacagtcatcggctgtttcctgctgctcctttcctcccaccagcattttactctgaaatagtggttctcaaagtgtggtctccagactgtagcatcagcctcagggggaaattcttaaaaatgcaaatttcccagccgcaccctggacgcattcacccaaaaactctgggagtggagcccagcaactgagccatgctaaggttggtgagccgctgctctggaacattgatccctcccaaactgcagcaaagcaagcacctgggtgtagctctggctgtgtaggtgctactacaatctgctggagtcactgcttgtcggcagagatgccgtgggagctggcctgggtgcctccacgttggccgtcaccaccaggcagtggcctttggcctggaatcgaaggtaccagagggctgatagctcagtttttttatggcaccaagaaaagactttcagattggaggtatgggattttctttattttttaatcctcttttaatataaagtggccccttagcaaactttcaagatatttcacatcagaactggccgggaaatccggcatgtggacagacacggatatgccgtgtgcatttttccgttggaggaagagggtaggcttgggtgctggagggtgttgcctgggggcggagcgagaaggaagaaagggcgctgctggttcacacctcacccatgccctcctctcaggccccaatcaggatggaattaaaagaccctgggaggaaaataaggaaagcaacaaaggaaatgagttccccatacagaaagggaaattgcctttcccgttaaggtcagactggtccgaagtaaaggactggtgcgccttagcaaccgcctctgctgaagccctaacgctggagctctttcgccctcgcagaataaccgggactttcttgcagccggaaccagccacgtcctgattccacactcccttgaggagccagccagctccacatttactcaaagaatccgaagggcaccaagtggatgctctgccacacgattgaagagggcaagctgtctggggggttttccacctcttttcaactcaactattctgagctgaagtactggacccgttttgtttttcctgttttttcctgcttcggtaaatctggaaaaatcctgcaggtctgaaaaactgttggacttgacagcgtgtgtgtagcgccacctggtgaccacagcttatcaaaacagcttccttctggggctcttgtggatgtacatcaaaggctccagcttccagacaggtacacatcctgttctcacgcccggcccactttcccgtgggaatgtcagccactctgatttgccttggctgaaaacctcctgtctttgcatggaaaaaaacacaaataatatgaacaagcaacagagttttctttctctcttaagtaaccaagcatttaaaatcttctaaagcacacatttccctaattgagaaaggaagcagaagaaaaatttctggctgaaattataaatcataataaatggtcggaaataccttctcccttagattcctggggtcctagtgtagaggagacttcagttgcccttgacactacaacatcctgactaaaagcctgtttccaaggtgatatttgatagacatgaaggacccaggtggaaaagaaggtagtctggacggcacggcaaggagtggaacacgcaggctatgaggtgtcagcagaaatcagttctggtcctggcactgctaccaacttgctgtgtgaccttgggaagttacttaagctttgtggatctcaatgccccagactcgttaacttctttactattttttcccataaattcagtgtttctgaaagatgttgcccaccagaatgcatctctaaaataggagcttaataagctttctgtcttgagggatcagacgtataaatgtcaggcaggccttctgatgatcatgatgcaaccagagttaccacagtgagtccatatcacagacaaaggcgaagacacttgatcccttcttaacctggtctcccacccatgaatgatttttgttaggatttcagcatgttgaaactaacccacagaccctagttacaactttctcagggcctgagagctggggaatcccagtttgggaaccaaaaaactagaaaatcttgagggcaactctggctgtcatgaactaaaacagagcaaagatggaagcctgtggtatgtgcgtgcaggtagaatctcgatttgagaaatggcgttacaaggaattaacacttcagaaatgccagctctgtgccaggatttttttattttattatgtatatttgtcatggacaacatgttttggaatatgtatacattgtggaatggttaaataaagctaattacatatgcatgtgctcacaaagttatcattttaggggtgacttaaaatctctcagtgattttcaaaaatatatgttattaatcatagttgcaatgttgtacaatagatctcttgaacatatattcctcttgtctaactgaaattttatgttctttgaccatctccccaactgccccccaacaagcctgaaagccctggtaacccctattctactctctacttctttgagttcaactttttaagagtccacatatgagatcatgcagtatttgtctttctgtgcctgacttatttcacttagcacaatgtcctttgggttcatctatgtcacaagcaacaggatgtcctcctttttaaaagactgaatagtattccatggtgtgttttctttatccaaccccattttctttatccatccatccgttgatgaacacttaaacacttagttggtttcaaatcttggctattgtgaatagtgctgcaatgaacatggcagtacagatacctcttcaacataccaattttatttcctttggatatatatacccaggagtgggattgctagatcatatggtagtactatttttaattttttaaggaacctccatactgttttctgcaatggctgtgttaatttacattcccaccagcagtgcacaaggcttccctgctctccacaacctcgctagcatttgttatctttcatctttttgataacagcattccaacaggtatgaggtgatatctcattgtggttttaacatgtatttctctgataattagtgcagaagttttagatacagaatcacagttagtcctgacaataatctctaaaatacccatgcagatggggaaagagctgcagagaagttaaagaaattgtctgcaccttacagctgagaccagaaccaggtctgtataatttcagagcacataatctttcaaagtaacctaacaaaatcacagcaacttttaggttcacagagaacaggccaaaaaaacaaacaaacaaaaagaaagaaattatagtaatttccaggtatgaaccagtaatccaaactaaacatattttgttgaatgaatatcctggattctactatgtttctccaagtccccactgtcttaaaacatagcatttggggttcagtagttactgataaaccttttgcatatctatgcactgttagttctttaccctacacattattttattgtagtaaagccaattttctgacatttatctgaaagcaaactgtgaagtacttccattctacttcctggtgatttttagtgacctggtgccatttgaacgtatgtgtcctccaaaattcgtatgttgaaacttaaaccccaaagcaatggtattagaaggtggggcatttggaaggtgattaggtcatgaggccgccaccctcatgtgaatgggtttagtgcctttataaaagggctggaaggaactagctaggcccattgcccttccatctcttctgccacatgagggcgcagtatttatcccttctgctcttccaccttttccaccatgtgagaacaccagagaaaataccaatctgtggccaggcgtggtggctcacgcctgtaatcccagcactttgggaggctgaggtgggcggatcactaggtcaggagatcgagaccatcctggtcaacatggtgaaaccccatctctactaaaaatgcaaaaattagctgggcatgctagtgcgctcctgtagtcccagctactcaggaggctgaggcaggagaatcgcttgaacccgggaggcggaggttgcagtgagccaagattgcaccactgcactccactctggcaacagagcgagactctatctcaaaaaaaaagcaagcaagaaaataccatctgtgggacaggccttcactagacaccaaatctgctgacactgtgatctgggacttcccagcctccagaactgtgagaaataaatctcaactgcttatgaattacccagtctgtggtgttttgctatagcagcaggaacagactaagacattcagggtaatgtgtcatttcaagacatgaaagctcagttctgtaatattttcttctcttattcctttgataattttcttctacccatcatctgttttctctttctgaaacttctactagttaaatattaaacaactctggtttcttaacctttcttgtgtatattatgattcaactaggatcaaaaaaatatctaattaaacagtagcttaaacaaattaggggttttttttgtttttgtttttgttttcacacaagaagtcaagaagtcattggaccagtgttatttcagaggctcaggaatgtcagggcaaaaatatctggaactctcttggtctcttacccatggctacaagatagctgctgcagctccatccatcccatccacattcaaggcagaactaaatgagcagcagaaggaagcagaaaggtttgtatttgtatcagaagaataaagcctttccagaaattttctacagacttaaacttatgactccttgaccagaaatgtatcaaaaggcaaatttaattacaggaaagtctaagaaaggaagttttagtatcccaccatgaaagtgcaggaagacaagagaaaggagggttgtaatgaaggaatgagacaatccagtgccctattttcttttttcttttttttcttctctgagacagagtcttgctctgtccctcaggctggagtgcaatggtgccatctcagcttactttaaccttcgcctcccaggttcaagcgattctcctgcctcagcttcccgagtagctgggattacaggtgcccaccaccacgccaaactaatttttttgtatttttagtagagacagggtttcgccatgttggtcaggctggtctttaactcctgacctcatgtgatccacctgcctcggcctcccaaagtgctgggattacaggtgtaagccaccgcactgggccagtgtcctatttttgtcctttttttttttttttttttttttttacttcatgcaagaattcctcaattttatcttctaaactttctgttgatttttttttgtttctgccctaattattttaatttctaagagtgttttcttctgatattttttgttgtgttgttttaatagcttcctatcttgtttcatagctgtaataccttctcatctctctaaagatatttataacttctctttaagtccattttgttttttgccttttcctcataatattttctttttcttcaaaattgatagctctccccacacatagacattttagcctctgtcttctatttgggtagcgtccctcaaaagtctgatgatctgggctgttgattcatacataaatatgagacaccaagaagttgtttggaggagctgtgtgattaaattagaattgtcccctggcagcgtgcagagtgatcaggtgttgagccagctctttcatggggcagacccccacaaccagtgtcattatgtgtgagtattttctctggatttactgagtttttccattgattttccactctggtcttcaatataatggagttggagaccagggtccaagcagtaattccactgccatagtgggagcagggaggatggtgggagtactctgagccgaagactctggtcaatttctccagagaaggaacttcgtgttctacagaggttagagaaaggtcatactctgatggtgtggattagaggtctaaaagatcctttgagaaaccatcaaataatctctctgtcttcatctccatgatcttgtcctcctttgccccttccactgtactggtgtccccaatttcaaaaggtttcaggtgttctgttgaacaaatcttttgtttctcattactcttcccttcctgagatacgtgggtttcagcctccgctgctaagtgagttaccattcctcaaaccacttttcagcttctctactcttctctccctccaattctctctgtccttatgagtttatgcctttttagtccttcattgtaattttggacagggaggagagggtggaaatgaagctcagatatatgtaagtattgaatctgccatgctaaacgggaagtctacacatatttttttaatatttccaatttcacaacacaattcctccaaaaaaaacttatggagctttttattatgaatgtgtcactgacattcagtcataatctatcttagcaacgatataggcacataccagactgaaaagatttgacaaacggtattctgagaaacccacatttggtcaataatcaaggaaataatttgttaaaaaggaataagatgaaacaaatccacattgcgtttgagctctataagtcaaagatacagttttaaaaagtaaactcaagtaatccaatattacaagatctagagggtcaggacaaagtgagttaggcttgcacatcaaagaaatagctaggcaactaccaaaaatgtttccaggtgaaatcaagttgcaaaattgtataaacaatcttgagataattaaacaaaagaaaatatattttcagatgttaagggctgcagagggaaaaagagcgactctatatagagaaaattaatatactggagcttatctcctaagaatggcttctgaagcataaggtgtttttttttggttttttttttttttgagagtctcactctttcacccaggctggagtgcagtggcatgatcttggctaactgcaacctctgcctcttaggttcaagtgattctcgtgccttagcctcctgagtagctggaattacaggcacgtgccaccccacccagctaatttttgtatttttagtggagatgggatttcaccatgttggccaggctggtctcaaactcctcacctcaagtgatccacccacctcagcctcccaaagtgctgggattacaggcatgagtcaccatgcccagcctgaagcatacattcaatctaacaagtcttctaggtatttgttctacagacacagttacccaagtgctgaattgcatacattcaaggatatttattttggagtattttaaatcataacacaaaatgggaatattctataaatatttcaataaggtctgccagacccatatatccagtagccatgggaatgatatctaagctgtgagtgaaaaccaaaggattaaaaacatgggcatccaagagaaggtcagggttcaacgccagcacggtctttgacacagcggctagcaaagattcattggtctgtgcaccatttccagcagctatactccagagttgctggtgctcaccatctcttcacttctctgcctggtatttagaaataaggctgatctccttacagtgaataattctctggtgcaggccacgagaggagcctggacttcgtcctccttgtggcagtaaagaggagcctctcccctctcttctggaatggtatcagaggagcttagtagagactcgagattttcattattatccaaaggtcacaaggccacccccaccatgatgtcattggagactacctggagaggctcaaggacccgtgaatctataacaaaagatctaacatttatgtcctcagacttccaaaaggagagaagcaaaaagacataaccgaaaaagtattctcacagaaatatagttgaaaacttcccaaatttgccaagagatgtaaatgtacagtttcaacaggctgagcaaacctccaaacataataaacccaaagaaatccacaccaagagacatcataatcaaatttctgaaaactaaatacaaagaaaaaaatcttgaaatcagccagaggaaaacatggcagaaacaattaaaatcgaaatagatttctcatcataaaccatgtattccaaaagaaaagtgacacaaatatttttcaaatgctgaaagaaaagaactgtcaatccagagtcctatacccagtaaaaatatcctgtgagaattaaggggaaatcacaatattctcagatgaagaaaaactaagataatttgtcatcaggagaaccgccctagaagaatagctaaaggaagttgtctaaacagaaaagaaatgatacaaggaggatggaacaccatgaagcaaggaagagagtacatggtaagcaaaaatattggcaaacacaataggctttatttctcctcaagagttttccaaattgtatttgatggttgaagcaaaacttataacactatctgatgtggttctcaatgtatgtagaagaaatatttaagacaattatactataaacaggggaagataaaagggtgttatggggggaaagagttctatacttcactcaaaggataaaaaagaacatcagttgactgaaataggttatggatacacaatggaatacttagagcaatcactaaaagtgctatacaaagaaatacaaatgctaaaaaagaaatacattcaaaacactatagataggctgggtgatgtctcacacttataatcccagcactttgggaggctgaggtatgcggatcttttgaggtcaggagtttgagaccagcctggccaacactgtgaaaccctgtctctactaaaaatacaaaaattagccaggcatggtggcagacacctgtaatcccagctactcgggaggctgaggcacgagaatcatttgaacccaggaggcagaggttgcgatgagcagagatggcaccactgcactccagcctgagtgacagagcaagactccatctcaaaataaaacaaaacaccacagataaatcaaaatggaaaaatgttcaattaacccagaagacagagaaagtgaacagagaaacagaaagcagaacaaacaaaacaagaaataaaatgtcaggcttaagttatagcatatcaataagtacattaaatgcaagtagccaaaataatcaattaaaagacagattgacagattggatttacaaatatgacccacctgagtgaggcctggtggcttgcacctgtaataccagctacttggtaggctgaggtgggaggattgctcgaggctaggagctcaagaccagcctaggcaacatagcaagaccctcatctctaaagaaaaaaaaaaaatagctggaaatggcagcttgcacctgtagtcctagctactcgagagtctgaggtgggaggatcacttgagcccaggagttcgaggctgaggccacagtaagccatgatcacaccactacactccagcctgagtgatagagcaagacccttctctaaaatatatatattcagattgaaaaaaaaaggatagaaaaagacatagcatgcaagcattcataaaaggaaagcagagatcgagcactatggctcacacgtgtaatcccagcactttgggaggctgaggagggtggatcacttgaggtcaggagttcgataccagcctggccaacacggtgaaacccccgtctctactaaaaatacaaaaatcagctgggcttggttgtgggcacctgtaatcccagctactcaggagactgaggcaagacaattgcttgaatcctggaggcagaggttgcagtgagcagagatcgcaccattgtactccagcctggacaacagagtgagactctgtctcaaaaaaatggaaaacagaaatggttatattagtatcaagctaaagtagacttcagagcaaagaaaattgctagagacagggagggagactacataatgatcaaagggtcaatccaccaggaagtattaacaatactaactgtctgtatgccaaacaacagatctgcaaactatatgatgcaaaaactgatagaactgatagtagaaatagacaaatccacaattatagttggagactccaacactcctctctaaacaattgatagaacgagtagaccaaaaatcagcaaggctgtagaaaaactcaacaacaccatcaaccaacaggacctaattgacatttgtagaacagctgacacaatagcagaatatacattctaatacacatcagaatacacactaaacatacaccaagatagaccatatacattctaatatacatcagaatgcacactcaacacacaccaagatagaccatgtacgttctaatacacatcagaatgcacacgtggcctcccaaagtgctgggattacaagcatgagccaaagtgcccagcccaatatgaaatagataatttgaatagccctataactattaagaaaatttaattcataattttgaaattccctcccagaaaaatatccagacctaaatgctttcactagataactctaccaaatgtttaaagaattaacaccaattctacgtaatctcttccagaatataggtaaggagggaattcttagttcatttatgctgctataacaaaatacctgagactgcatcatttataagcaatataaattttttctcacagttctggaagctgggaagtccaagaccagagcaccagcagttctggagtctggtgagggctgctatctctgcttcaacatggcaccttgttgcatcctcctgggagaataaatgctgtatccttacatggcagaaggatagaaggacaaaaagggcctagctagtttcctccagacctttcatatggcactaatccattcatgagggctctccctcatgacttaataacttcttaaaaggcctcatctgttaacactaccataatggggattaagtttcaacatgaactttagaaagaacacaaacactcaacccatggtatcttcataattggttttatttctaccaagaccagatgaaggcagaaaactaccaaaaaaaaaaaaaaaaacaaaacaaaaaagtcagaaaaccacagatcaatactatcttgaaaacagacatgaaaatcctgaaaaaaaaaattagtaaataaaattcagcagtatgtaaaaagaattatacatctcgaccaagtggggcttattatagggaggcagagctagtccaatattggaaaatcaataaatgtaatcaaccatattaacaagctacagaagaaaaatcacatgatcatatcaattgatgtggaaaaagtatttgacaaaattcaacactcattcatgatttaaaaaaaactctcagaaaattatcaatagaaaagaaatgcatccacttagtaaaaagcacctataaaaaacctacagcaacattatacctgatggtgaaagtctgaatatttttcccttaaaatcaagaataagacaagcgtattcacacttacattcttattcaacatagtactgaaagttttagccagtgcagtaagacaaaaggatggggtgagggagaataaaaaggaagacattattatctatatatagaaaattccaaggagtatacaagaaaaacaaactcttagtactgagttcagtaaacttgcaggatataagataaacatacaaaaatcaattgtatttctatatactagcaatggacatgcagacatcaaaatttaaaatataatatcatttgcaatcactcaaaaagaatggaatacttaggtgtcagtctaataaaacatatccagggattttatgctgaagactatgctatgccgatgaaagaaataaaaatatctaaataaagggagagacatactgtgtttatgactagaagattcaacataataaaggtgtaaattctcccaaattgatatgaagtcttaatataattcctatcaaaatcccagaaagttttaaaaatagatataaacaagcttatcctaaaatttaaatgaaaaggcaaaggaactggacttcaaaacaattttgaaaaagaagaaaaaaagtgggaggtgactcagtctatctgatttcaagacatattatataggtcagtaatcgagactatgtgatattggtggagagatagacacataggtcaatggaacagaataaagaatccagaagcagatccacataaatatgcccaactgatttttgacaaggtgcaaaagcaactcaacaaaggagaaacaggctttcaacataagatgctggagtgattgcacatctattaccagaaataatgaacctcaacctaagcctcacacctcaagcaaaaattaactcaaaatggatcatgaacttaaatgtaaagccataaaacacttaggaaaaaaacataggataaaatagtcaagatctagaatgacgtaaagtgttgtgtttttttcacatatggagaatgccctgtgatagggttcttagacttgacaccaaaagcacagttcataaaaggaaagatgtataaactggacttcatcaagattttaaatttttgttctgtaaaaaatcttgttaagagaatgaaaagacaagctacagagtgggaagaaaatatttgcaaaccatatatctgacataggactagtatctggaatatataaagaactctcaaaaattaaacaataagaaagcaaacaatccaattaggaaatggacaaaacatgtgaagagacattttaacacagaaaatatacagacgacaaataagcacgtgaaaatatgttcaacagcataagccattcgtgaaattcaagttgaaaccactatgcagtattactacatatctatcaggatggctaagatgaaaaatagtgacaccaccaaattctgacaaggatgcagagaaactagatcactcatatgatgctggtgagaatgtgaaatggtggtgtttggaagtttcttagaaaagtaaacatgcaactgccatatgacccagcaattgagctcctgggtatttatctcagagaaatgaagacttgtagtcacacaaaagtttgtgcacaaatgtttatagcagctatattcataagagctcaaaactagaagcaatctagatgtccttcaataggtgactgcttagacaaaatatggtacattctatgcgatgttattcaacagtaaaaaggaacaaacttttgataaacacaacaacctagatgaatctccagaggattaggctgagtggggaaaaaagccaatcttggccgggcgcggtggctcacacctgtaatcccagcactttgggaggccgaggcaggcagatcacgaggtcaggagatcgagaccatcctggctaacacagtgaaaccccgtctctactaaaaatacaaaaaaattagctgggcgtggtggcgggtgcctgtagtcccagctactcgggtggctgaggcaggagaatggcgtgaacccgggaggcggagcttgcagtgagccgagatcgcgccactgcactccagcctgggcaacagagcgagactccgtctcaaaaaaaaacaaaaaacaaaaaacaaaaaaaaaagccaatctcaaaaggttgcctatgtatgatttcatttccataacgtttttgaaatgacaaaattctagaaatgaagagttgattagtggttgtcaggagttatggagggggtgggagcaggaagtcacgggttgtggctataaaatggcaagatgagggaactttatggtaacgaaaatgttctgtatcttgacagtatcaatgtctatatcctgattataacattgtgctattatatgctgttaccattggaaaaaaaatgggtaaacggtacacaggatcttgattatttcttacaactacatatgaatctacaattatctcaaaattaaaagttaatttttaaaaacaaattcagggcatacacatacaaaactaaatttatcttttataagttggcagggttctgctgatatagaccaggtggctctgctgaacttagctggcctcactcgtgtgtgctgctgatctaggctgggttcctccaggtcaactggagaatttgattctgtttcatgtatctgtcatcctcagcaggctggcctgggcatgttcttatggccatagctgaggtgcatgagaaaacaagctctagcttgggcgcagtggctcacgcctgtaatctcaacactttgggaggccaaagcaggtggatcacttgacgtcaggagttcgagaccagtctggtcaacttggtgaaaacccatctttactaaaaatacaaaaacttagccaggcgtggtggtgcacggctgtaatcccagctattcgtgaggctgaggcacgagaatcgcttgagcccaggaggcaaatgttgcagtgagccaagatggcaccactggctgggtgcagtggctcacgcctgtgatcccagcactttgggagactgaggctggtggatcacctgaagtcaggagtttgagaccagcctgaccaatatggtgaaaccctatctctactaaaaatacaaaaattagccagacatggtgacgtgcgcctgtagtcccagctacttagaaggctgagacaggagaattgcttgaacccgggaggcagaggttgcagtgagccaagatcgtgccactgcactctagcctgggcaacaaagcaaaactccatctcaaaaaacaaacaaacaaaaaaaaatcacaccactgcactcctgcactccactctgggtaacagagtgagacaagacgagacaagacaggacaggacaggacaggacacgacaggacaggacaggacaggacagggaaaggaaaggaaagaaaaggggaaagggaagaagaaaacaagttctcgtggacaaacctctctacagcccaaatttgagtcacggcttttacacactaatgacaaaagcaagtcacatgattgagcccagaaccaggggacagggcaggtcattcatgcatggtgggagggcactgtgaagttacgtggcaacaggcatgaatatggggcagaggaggtgaaaagctggggtcaaggactctaccaccatccttgaacacctccaggactaaaaatacctattgcggctttctcttcttactgcagtaactcttacccactcccccactctacctgcctcatccaagtgagggggaaatgaaaggaagaagaggaaacagagcattgaaaatgtgtgcctctgtgtgtgtctgtgtgtctgtgtgtgtctgcgtttgtgtctatctgtgtctctctgtgtgtctgtgtctgtgtatgtgtgtctgtgtgtatgtctgtgtatctctgtgtgtctatgtgtgtgcctgtgtgtgcctgcgtgtccgtatatgtatgtgtttgtctctgtgtctgtgtatctgtgtgtctgtgtatcagtgtgtgtgtgtctatcagtgtgtgtgtctgtgtatcagtgtctgtgtgtctgtttgtgtatctgtgtgtctgtgtatctgtgtgtgtctgtgtgtgtgcctgtgtgtgtctgtgtatctgtgtgtctgtgtgtctctgtgtgtggctgtgtgtgtctctgtgtgtgtgtgtacctgtatctgtgtatctgtgtgtgtgtctctgtgtgtgtctgtgtgtgtgcctgtgtgtgtctgtgtatctgtgtgtctgtctctgtgtgtggctgtgtgtgtctctgtgtgtgtgtctgtgtttctgtgtgtgtctgtgtatctgtgtgtatgtctgtgtatgtgtgtgtgtgtctgtgtgtgtctgcatgtgtgcctctgtgtgtgtatctgtatgtctgtgtatgtgtccctgtgtatgtgtctctgtgtatctgtgtgtctctttgtgtgtgtctgtgggtatgttgtggaaatccttggaaatctcctatttgtgggaactgaatccccagcactgccatgtaaatatttttccctctcatgggccactgtggccattgtccattgtttcaaagaccctacaacaggatctgagtttccctttgccaaaagacaggtcacagggaagggaacacagctgacccttgaacaatgtggggttagggatgctgacccccacgtcgtcaaaaatccgcgtataacttttgattcccaaaaaaggagtcaggctgatgtctgcccaatattctactgaacttaactaccaagagcctacagttgactgggaaaccttgctgataacatagtcagttaactcatatttcgtgtatgaattatataatgtattcttacaataaagtaagccaaagaaaagaaaatactattaagaaaatcatgaggaagaaaaatatttcctcttcgttaagtgcaagtggagtttcatgaaggttttcatccttattgtcttcacactgagtagggtgcggaggaggaagcggaggggttattcttgctgtctctgggtggcagaggcagaagaggcggaggaagtaaaagggaaggcaggagaggcagacacactcagtgtagcttgtactggaaaaaacctgtgtataagtgaacctgtgcagttcaaatccgtcttgttcaagggtcaactctctataacgtctacaaatgtcctaccctgcgccaggctgcctctgccccaatctttattccatcttctgccccatctctgactctcttctcacctttacagttttctagagtccttgttcctttcctagcacgcacccagactttatgttatgagaatccctgtccaaagccactgagagcagtctctttgcctccgtatcttcattagtaaaacatgggtatcagcagtgcccacctcacagcgttgatgtgaggatgaagcgacatgactgataatgagtttacactgcccggtatgcggtgattcctcaataaattgcaggatgtgttttttcttttcttttaatatgggggtaggggctgcccagtctcactgcagacagctaaaggaatcgcagcaccaggcgcgatggctcacgcctgtaatcccaacactttgggaggccgaggcgggtgcatcacgaggtcaggagttttgagaccaacctggcaacatggtgaaaacccatctctactaaaaatacaaaaattagccggacctggtggcgagcgcctgtagccccagctactcaggaggctgaagcaagagaatcgcttgaacccgggaggcagaggttgtagtgagccgagaccgcgccaatgcactccagcctgggcgacagagcgagactccatctaaaaaaaaaaaaaaaaaaaaaaaaaggaatcccagcaatccaaggcggaattctagaaatagtttcccgtagaaacaccgttctacactgcagtcttattctatcccactattattactcccaaagattctaaggtcccagtgctttcgcttcatcctagaggctaaatgggctcccctggactcgcctggcagaactaaccacctagaagaacgttattgtaagggggaaatgtgagtgctacataagtttcttataaatgtgcttttgaaatagagtccactcttaagtttgatatttcctaaaatttaatgtgtgaaggaagatgcttgggagacaatccgtttatcaggctgatatatggcagatagtctactgacctccctgagcaagaaccttaggaatgaggccaggtggcagaaacactcagggccaagggtagggagcaaaactgtgatgtaaagagacctagatggacttgggaggaggtggggttcaataggaggccacgactaatgccctggcatgcaaaggctggacaggagtcttgaaagagcctcaattagctgggcgtggtggcgggcgcatgtagtcccagctactcgggaggctgaggcaggagaatggcgtgaacccgagaggcggagcttgcagtgagcctagattgcgccactgcactccaacctgggcgacagagggagacaccatctcaaaaaaaaaaaaaaaaagaaaagaaaagaaaagaagaaacaaagagcctcaaaaatatggaaaaccagatcctaagagcaaaatgccaagggggacacttattagtgaggagtctgcaaaaacagaaaggttttagccagaagcttataggagtagacctggaacccaaattgaaaaggaacagtgcgacccgtaatttgagaaggaaatagaataggcagaagaactacagaaactatagcttcgagtctaagagcctatttacaggggtgtccaatcttttggcttccctgggccacactggaagaagaattgtcttgggccacacataaaacacactaacactaatagctgatgagctaaaaaaaaaaaaaaaaaaaagaaaagaaaagaaaagaaaaaagaatggccgtgcataaatctcataatgttttaagaaagtttacaaatttgtgttgagccacattcaaagccatcctgggcctcatgcagcccgtggaagcttgcataagagagagatttaggaccttttggcggaagtgctcgataaggattgaatagcaccataaactgaagctaaactgaaaggttttagaatttaacttaagacacctcaaatgcttttagatgaaactcaggacttttcactgtagtaaagttcagcgtgaaattgaccttgtaggggcaccagacagcagtgagcagggtgtataagagtgagggaggggttaataaatagagatggtgggaaaaggagctggcttttcgtgagttcagcttcttgcagactagactagcaagagtcaagaatgaacctaagccagactcaggtctactgggcagtgctaggcctgtctcaaccctgtttgcacatcaggtaccccatgcgtctgctgtagtctgtagctacatgggaacctaaaacatcaccgaggtttctagtgatgttgaaactcagctaataaacagggaatcccgagggttcccctctactccactcctgacagtggccatcctgcctctgcttgaataccttaactcgcctctcatgaggcacccatctcctcattaaatgattgtcactgggaagaatccgccccacacagccagatcaaatttaccccctggtaactttcagcccctggtccccattctgctctttagcactaggtagctgaatcgaatctttccatgagagtcaattccattcctcctaaatcttctctcttctaagataaatagtccacattatacaatcttaatacccaattcaatgagcacttcatgatagtctaatatatgcaaagcaccatgcttgtgccaagtgggaccctaaagcgaatattatctccttgctctttaggcaaacagggtgaagacaagaggcataggtgatggacactaaaacaaagaccgtaagtactgtaatagctacacacaacttacaatcatataggcatggggaaagagtagcccagcttaccttggaggatctggaaaggttctaagaagaagtggaattgagttggagttggaaagacttcaacaatcagatgtgagaaggacgtgggtggtgagtgcaaagaaaataggacacggctgaggaccttgttttctttttcttttttgaggtttttttcttcttcctttgtttttcgttttatttttatttttcattaacaagtagtaataatacatgtttatggagtacaatttgatgttttgatataggtttacaatgtggaatgattaaatcaggctaattagtaaatccatcacctcacaaacttaccaattttttgcagtaaaaacatttaagatctacttttagcaattttgaaatatacaatgcattattacttattatagttaccatgctgtgcaattgattagtaaagcttattcctcttgtctaactgaaactgtgtagccttttcccaaccaccgctccacccccagtccctggtaaccaccattgtactctctacttctatgagatcaactttctcagatcctacctatgagtgagatcgtgcaatatttgtctttctgtgcctggcttatttcacttagcgtagtgtcctccagattcatccatgttgtcccaaatcacaggatttcacccctgtttaaggctgagtagtattctattgtgcatatataccacattttctttattcattcatctgttgatggacacctagattgattccatatcttggctatggtaaatcgtgttgcaatgaacatgggagttcaggtgtctcttcaacatactgatttcaatgcctttggataaatacccagaagtgggattgctgtatcaggaccttggtttcttagcttctgtctgaccttgagcatacctaaaataagagccctgaacgagataatttctaaagtttagtgatagagaccaaaaggagtatacgtctgagcattccaacttaggccaaagcctaaaagtgagaagcctgcccatatcaagggagtgaggtgtgtgtttggggcaggggtagtagaagagcaagacggttcatgaattcagtattcttgtttcactgatgcagcacccatcaccattctgatcaggtcccttggggacatggacagtgtccttagaatgacaatgatgatggtaccaccagcaccaccaccaccatttctctagcatgtgggtgagccaaacacctttggaaacaccttacatatttacatttacatcctactgaatcctcataacagccctgtgagatagatagaatttttattattctcattttacaaattagaaagctgaggcacagaaaggttaaataacttgcccaagtccatagggctaatctaatagcagagctgggatttgaaggcaagtagtctcactccctgcttttcttcctcgaaaaacacaagggcagggctgaactcagctcaggggacacaatctataccaggacaaggttacaatggccctataacttcttcttcttcttttttttttttttgagacgaagtttcactcttgttgcccaggctggagtgcaatggcgcaatctcagctcactgcaacctccacctcccgggttcaagcaattctcctgcctcagcctcccgagtagctggggttacaggcatgtgccaccacacccggctaattttgtatttttagtagagatggggtttctccatgttggttaggctggtctcgaacttccaacctcaggtacccgccttggcctcccaaagtgctgggattacaggcgtgagccaccatgcccagccggcaatataacttcttttgcattctcattaactcagcctcagacgacactggcttccttggaagccactgcatactgatgattgaagtggagctgacaatcacctaaaaacccctaaatgcctttgacatgagccactcttaagccaggtctctcccattctgttcacgtgtggctgatcagttcaaactaaatgttgggttttacgttgaaccctatacaattctaggttttagcttatagtttcaccctactataattttgaaacatgatatgttacctaatgttacctctcccggtttagtaataacataaacaaaaacagttgacagttatgggggccctgactttgtgccagacaccctgctacgtatttgtttgtttaatgtaataccttatataatcatttagtctttacacaaagttaaatattattattattctcacttaataggataggaaaccaagtctagtgaagttaagaagcttgctcaaaatccaattaggggctgggcgcagtagctcatgcctgtaatcccagctctttggaaggccaaggcaggtggatcacctgaagtcaggagttcgagaccagccaggccaacatggagaaaccccatatctactaaaaatacaaaaaattagccaggcgtggtggcaggtgcctgtaatcccagttacttgggaggctgaggcaggagaattgcttgaacccaggaggtggaggttgcagtgagccgagatcatgccactgcactccaacctgggcaacagagcaagactccatctcgaaaaaaaaaaaaaataaaatccaattaggaagggactgacccaagagtcatacctaggattatctgactccagggcctgaacttttatctatgttctctgcagcgtcctcacatcttctacacacttgttattatctaagtcaatcatgaaaaatgatgaaacaggccaggcgtgttggctcacacctgtaatcccagcactttgggaggccgaggcgggcagatcatgaggtcaggagatcgagaccagcctggccaacagggtgaaaccccatctctactaaaaatacaaaatgagccaggcgtggtggcatgtgcctgtagtcccagctactcgggaggctgaggcaggagaatcgcttgaacccaggaggcaaaggttgcagtgacctgagatcacaccactggactccagcctgggcgacagagcgagactccatctcaaaaaaaaaaaaaagaataaagaaaaatgatgaaacagaatcagggagagaattcagaggaaaatgacatccctccaggtgtgtatgaaccaattactcatagagtcataaacagttagagaatgaggcatttttcacaaaatattgagggctggagaggttgaacaatttgctcccactcacacatctaggaaagagaggagatggaaaagtaaacaatccagaaaggtcaaggccctcattccatcaatgcacaattcaagtacacatacgtgggaaaccatctgaaaagttttgtaattacaatttcatctagccagcaattctccaactcattcacatgcatctcatgacatcgttgtcagaagccttgctagagtgaacgtgcacttcatcaaacacacccctgatccgtgggagatgggattcgtttgtgctgatctactctccaggaacacaagaaactcaccattctaacggttcataaatcatccatttaataccccagtttcagattttgcaggaattaacatcaatgcacggtttttgagacccgccaacttgctgaaacagtgcaagccacctgcagtcctcggataccactcagtgatggccctaggtctccctactctgggcctgagattcacttacagctgcaaaacacacctgtgcactctcctcataggcagaacgctttcacttctcagtcatttccaactgagactgttttctctggtagagaatacagaagtcaaatggactcagagtggttctgccttgtctctgccttctgttgttgagaataaaccagaaaaatcccttcttctgtcattaacattttcaagaagctccgttcagtccagtgctcttatttcaggcctatcacaccctttcatatttgtgttttcatagccactgacaaagactgtgtccttgaccaaactttagtcaggttcctctgagcccaatcaggccccatccttgggcatgcccccacccccaatgtctgatcaccctcaaaatctgatcaaattcctcatccctcatcatccccgaggcgatgtctgatcaccctgcctggtcttcagcaaaaatcacactaggtcaacttagccagaatcccctgactcccaatgtttccccttagtaattttccacccactgaccccaccttattccttggttacaaatccccatttgcctctgctgcattcagagttgagcccagtttctctccctgaccacaagaccctattgcagtggtccgtccctacaccaactgcgatagtcccggataaaatctgccttacccttttaacaagggtcaagagtaaatttttccttaacatctcctgtgggcactatttgtatacatttaaagtgagagcttatccaagagcttcctttttagcctggcaatcaagtatcctttttgcttctttctcccgatcactccctaaacccctcatctatagtaagaagcagaatcagaatttgactccaagactgtgcctgaggagcctgagccctaaatactgtgctctattgttacctgtgttatctgtaaataactgagccattgattaaaacacagttaataggctgggcacggtggctcacgctcactcgtaatcccagcactttgggaggccaaggtgggcggatcaactgaggtcaggagttcgagaccagcctgaccaacatggtgaaaccccatctctactaaaatacaaaagttagctgggcgtggtggtaggcgcctgtaatcccagctactcaggaggctgaggcaggaaaatcgcttaaacctggaaggcctcggaggttgcagtgagccgagattgcgccactgcactccagcctggacgacaagagcgaaactccatctcaaaacaaaaacaaaacacaatcaataacagaacctagagatctctagctagatgcatctcaatcaattaagcatgcaatcaaagagactgaaggggacctgaggtccagataatttaagtgatttaaccaacgttaaagattatttcttaaggggaaaatcatgactctcacatgatataaaagaacatgtggcaaatattttatttaactaatttaactggagccagcaaaatattaaaaccagctcaaaggagaaaactccaactaccacacatttatagtcagataagaaataccgaaataaatttacaaacaggcaaaactggaaaaactggttaatatctacaggacaataaacaaaggcattccacgggagactatttgcattataatatgcaaggaattatttgcattacgatcagttttctatatgttaacttctttctaaggagttgtaaaatagcataatcaaaagcaaataaataagcatatctctataaaatcagataatccccaaaggctctaacattccattgaaaggatatccagtaatctctttgcccattgcaaatctttccatttttccctacgccaaagtcaaaaagcagtaatagcaactccagaaaagaggtgaagagagccgggctcggtggctcacgcctgtaatcccagcactttgggaggccgaggcgggtggatcacctgaggtcgggagttcgagaccagcctgaccaacatggagaaaccccttctctactaaaaatacaaaattagctgggtgtggtgacacatgcctgtaatcccagctactagggaggctgaggcagaagaattgcttgaacctgggaggcggatgttgcagtgagccgagatcgcaccactgcactccagcctgggcaataagagcaaaactccattaaaaaaaaaaaaaaagaagtgaagaacatcaacaaactgggctgcatctgaaccatgtgaagaagatggtcaggtttagtggttagcgtcatgggccttaaagacagtgcctgggctccctcaaattccagctttgcctcatgtgctcgtgtgaccctgggaaattttacttaagtcttttgtgtgtttgtctttttttttttttttttttgagatggagtctctgttgcccaggctggaggagtacagtggctccatcttggctcactgcaacctccccctcctgtgttcaagcaattcttttgcctcggcctccccgagtagctgggactacaggtgtgtgccaccacgcccagctaaatttttttgtgtttttagtagcgacgaggtttcaccatgttggccaggctgttctccaactcttgacctcaggtgatctgcccgcctcggcctcccaaagtgctgggattacaggcgtgagtcattgtgcccagactcttttttttttcttttttttgagacggagtctctgttgcccaggctagagtgcagtggcatgatgtcggctcactgcaacctccgcttcccgggttcaagcgattctcctgcctcagcctcccgagtagctgggattacagtcatgtgccaccacacttggctaattttgtatatttagtagagacggggtttcagacggggttggccaggctgttctgtaacattctaccacaaaagaagtgaaaatggcctgttcctgccttaactgatgacattgtcttgtgaaattccttctcctggctcatcctggctcaaaagctcccccactgagtaccttgtgacccccactcctgcccgccagagaacccccctttttcctttacctacccaaatcctataaaacagccccaccccatctcccttcactgactctcttttcggactcagcccgcctgcacccaggtgaaataaacagccatgttgctcacacaaagcctgtttggtggtctcttcacaccgacgcgcatgaaatttggtgccatgactcagatgggggacctcccttgggagatcaatcccctgtcctcccactctttgctccgtgagaaagatccacctatgacctcaggttctcagaccaagcagcccaagaaacatctcaccaatttcaaatccagtaagcggcctctttttactctcttctccaacctccctaaccctcagcctctttctcctttcaatcttggcgccacacttcaatctctcccttcttttaatttcagttcctttcattttctggtagagacaaaggagacacgttttatccgtagacccaaaactccggtgccggtcacggactgggaatgcagccttcccttagtgtttaatcattgcaaggacacctctctgattattcccccacgtttcagaggtgtcagaccacacagggacgcctgccttggtccttcacccttagcggcaagtcccgcttttctgggggaggggcaagtaccccaaccccttctctccgtgtctctaccccttctccacctttctggggtgcaagaaacccccaaccccttatccttcacccttagcggcaagtccggcttttctggaggagaggcaagtaccccaacctcatatctctgcaccccaatcccttatttctgcaccctgacctcatatctctgtgccccaatcccttatttctgcaccccaacctcatatctctgctccccgatcccttatttccatgccccaacctcttatatctctgcaccccatcccttatttccatgccccaacctcctatctctgtgcctgaccccttctctgcttttctggagggcaagaaccccctaccccttctccgtgtctctactcttttctctgggcttgcctccttcactataggcaagcttccaccttccattcctccttcttcttccttagcctgtgttcttaagaacttaaaacctcttcaactctcacctgacctaaaatctaagtgtcttattttcttctgcaatgccgcttgaccccaatacaaactccacagtagttccaaatagccagaaaacagcactttcaatttttccatcctacaagatctaaataatgcttgtcgtaaaataggcaaatggtctgagatgcctgatgtccaggcattcttttacacatccgtccctctctagtctctgttcccaatgcaactcatcacaaatcttccttctttccctcccacctgtcccctcagtcccaaccccaagcgtcgccgagtctttctaatcttccttttctacagacccatctgacctctctcctcctcgccaggccgagctaggtcgcaattcttcctcagcctctgctcctccaccctataatccttttatcacctcccctcctcacacccggtccggcttacagtttcgttccatgactagccctccccctcctgcccagcaatttactcttgaaaaggtggctggagctaaattaaagttaatgctcctttttctttatcccaaatcagatagcgtttaggctctttttcatcaaatataaaaaacccagcccagttcatggctcgttcggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgccttcactgtgagacaaaccccagccacatctccagcacacaagaacttccaaaggcctaaacctcagcgtccaggcgttcctccagaacctcctccccgaggagcttgctacaagtgccagaaatctgaccaccaggccaaggaatgcctgcagcccaggattcctcctaagccgtgtcccatctgtgcgggaccccactggaaatcagactgttcaactcacctggcagccactcccagagcccctggaactctggccgaaggctctctgactgactccttctcagcttagcggctgaagactgacgctgcccgatagcttcggaagtcccgtagaccatcacagatgccgagctttaggtaactctcacagtggagggtaagcccgtccccttcttaatcaatacggaggctacccactccacattaccttcttttcaagggcctgtttcccttgcctccataactgttgtgggtattgatggccaggcttctaaacctcttaaaactccccaactctagtgccaacttagacaatactcttttaagcactcctttttagttatccccacctgcccagttcccttattagactgagacactttaactaaattatctgcttccctgactattcctgggctacagccacacctaattaccaccttttccctcagttcaaagcctccttcacatcctccccttgtatctccccaccttaacccacaagtataagatacctctactccctccttggcgaccaatcacacaccccttaccatctcattaaaacctaatcacccttactccgctcaatgccaagatcccatcccacagcacgctttaaaaggattaaagcctgttgtcactcgcctgctacagcatggccttttaaagcctataaactctccttacaattcccccatcttacctgtcctagaacaagacaagccttacaagttagttcaggatctatgccttatcaaccaaattgttttgcctatccaccccgtggtgccaaacccatatactctcctatcctcaatacgtccctccacaacccattattctgttctggatctcaaacatgctttctttactattcctttgcacccttcatcctagcctctcttcgctgtcacctggactgaccctgacacccatcaggctcagcaaattacctgggctgtactgccggaaggcttcacagacagcccccattacttcagtcaagcccaaatttcttcctcatctgttacctatctcagcataattctcataaaaacacacgtgctctccctgctgatcgtgtccgattaatctcccaaacctcaatcccttataaaacaacaactcctttccttcctaggcatggttagtgcagtccgaattcttacacaagagccaggaccgcaccctgtaacctttctatgcaaacaacttgaccttactgttttagcctagccctcatgtctccgtgcagtggctgctgccgccctaatacttttagaggccctcaaaatcacaaactatgctcaacttactctctacatttctcataacttccaaaatctattttcttcctcatacctgatgcatatactttctgctccccggctccttcagctgtactcactctttgttaagtcccacaattaccattgttcctggcccggacttcaatctggcctcccacattattcctgataccacacctgacccccatgactgtatctctctgatccacctgacactcaccccatttccccatatttccttctttcctgttcctcaccctgatcacgcttgatttattgatggcggttccaccaggcctaattgccacacaccagcaaaggcaggctatactatagtacaagccactagcccgcctcttagaacctctcatttcctttccatcgtggaaatctatcctcaaggaaataacttctcagtgttccatctgctattctactactcctcagggattattcaggtcccctcccttccctacacatcaagcttgaggatttacccccacccaggactggcaaattaactttactcaacatgccctgagtcagataactaaaatacctcttagtctaggtagacactttcactagataggaagaggcctttcctacagggtctgagaaggccaccgcagtcatttcttcccttcagtcagacataattcctcagtttagccttcccacctctatacagtctgataacagacgagcctttattagtcaaatcagccaagcagtttttcaggctcttagtattcagtgaaacctttatatccattacagtcctcagtcttcaggaaaagtagaacagactaaaggtcttttaaaaacacacctcaccaagctcagccaccaacttaaaaaggactgaacaatacttttaccactttcgcttctcagaattcaggcctgtcctcagaatgctacaaggtacagcccatttgagctcccatatagatgctcctttttattaggccccagtctcattccagacagcagaccaacttagactgtgccccaaaaaacttgtcatccctactatcttctgtctagtcatactcctattcaccattctcaactaatcatacatgccctgctcttgtttacactgccagtttacactgtttctccaagccatcacagctgatatctcctggtgctatccccaaactgccactcttaactcttgaagtaaataaataatctttgctggcaggactatgctgaatctccttaggcactctttaatcagatgtcctaggtcctcccaattcttagaccttttatacctgtttttctccttttcttattccgtttagtttttcaattcatacaaaactatatccaggccatcaccaataattctaaatgacaaatgtttcttctaacagccccacaatatcaccccttaccacaaaatcttccttcagcttaatctctcccactctaggttcccacgccaccccaatcccactcgaagcagccctgagaaacatcgcccattatctctccataccacccccaaaaattttcgctgtcccaacactttaccactatttcgttttatttttcttattaatataagaagacaggaatgtcaggcctctgagcccaagctaagccatcatatccccgtgacctgcacgtacacatccagatggccagttcctgccttaactgatgacattccaccacaaaagacgtgaaaatggcctgttcctgccttaactgatgacattgtcttgtgaaattccttctcctggctcatcctggctcaaaagctcccccactgagtaccttgtgacccccactcgtgcccgccagagaacaaccccccttcttcctttacctacccaaatcctgtaaaaccccatctcccttcgctgactctcttttcagactcagcccgcctgcacccaggtgaaataaacacccatgttgctcacacaaagcctgtttagtagtctcttcacatggacatgcatgaaactgacctcaagtaatccacctgcctcagcctcccaaagtgctgggattacaggcatgagccaccacgtgtggcctgtttgttttttgagacagttctgtcacccaggctggagtgcagtggtttgatcactgcagccttgaactcctgggctcaagtgatcctcccacctcagcctccagagtatgggactacaggcatgcagtaccatacctggctaatttttttgattttttttttctttttttgtagagatggggcctcactatgttacccaggctagtctcaaacacctggcctcatgcaatctgcttcccaaaagcacacccaaaaggtgtgagctaccatatcccacctacttaactcttttgtatctcagtttcttcatatgtaaaatgggcataactgtcgtgcctactacacagctgagttaataattggcatggactcagtaaaataagaactattattgttaggcctctttggagccatggccacaacagcatgcctatctttactctaaaaattttgcccaactaggctcagaattctctctcaaccatctccaattttacagtaaaatgaacattctgtctccaaggttcccattgcttctatgagaccaaccagtgcctctttgtcagccaaatgcaaggatagaacaatgtttatcaccgtggcttcctttgacttaagagatggtattagcagcaagtgtgaaatgacctatgtttatcaggagtcttccatggaagtcatggtagtcagatctcctatcacgattacctcctgccttggtgcagggcgtgatctctgtactaagaacgtctttctccatctcatctctggccaggccagttatagcaacacagcactatcacttcaatccttctattattttgtcttcactcaaaccacagataagaggatcttcctacaggtataggggagaagaaaatttatttttcctctaccctcctaggttttttggctggggccctgcaaattagactgacgaaagatagattaacaaaagaaaaacagacagaagtttattattaacacatgcatacacacaggatcgctcaatgatgagtgactcaaaggagtggtcagaaattgggcttatagagcaccttttaaaaaaatataaatttgtaaaaaagtgacaagacaggccgggtgcagtgagtggctcacgcatataatctcagcactttgggaggccgaggcaggcggatcacttgaagtcaggagtttgagaccagcctggccagcatggagaaaccctgtctctactaaaaacacaaaaattagctgggcatgatggcgtgcacctgtaatctaagtgactctggagactgaggcaggagaatcgcttgaaccggggaggcggaggttgcagtgagcagagattgcaccactgcactccaggctgggcgacagagtgagactccatctcaaaaaaaaaaaaaaagaagaagaagtgacaagacaaagggaaagagctttaggcttctggaggtggcaaactgtgggaaggtaagtagatgggaaaagtaatggaagataaagattgccttagtgaggttggttatgtaggttcctccagcgccatctctgggctgcttaagagtccagagttgtctccagcgactgagaatcttcctgtcctccctggtagggagacatggggagcagagagtttctctttgtttctatttttttttttttttgaggcgaagtctcgctctgttgcccaggctggagtgcagtggcacaatcttggctcactgcaacctctgccacccaggttcaagcgttctcctgcctcagcctcctgagtagctgagattacaggcacccaccaccatgcccagctaatttttgtatttttagtagagatggggtttcgccatgatgaccaggctggtcttgaactcctgacctcagatgatccacccacctcggcctcccaaagtgttggaattacaggcgtgagccaccgcacctggccgagagtttttcttgtgtctgcttcatcttcattgccttcagctcaaaatgatcttaaggttaaagtgttgtactttggggagtggcatgttgaccccttcacagatgttcttcataatgaatagtgcttctcctctgctccgtttcccaaatctttcatttcaaccagtcacagccttttattgctccattccaactctgatcctatttcattgagtttcatcattgatatcaaaacaaggataaatgtcaaaccccagagtaatctggtgtccactctaaaatctgctcatctggcctttcaagtcttctttggttactcagtgatgggcaaaaaccccaacgttttcctgaggatgggctttttatctatattattcaaactcttaggcatttttatctaagatatatttccagtgatgatataaatcaattccagaatcatagattaaagtgaattcaaagcatatataacaatttcaaaaatattcatacccaataattccactctcaggcatcatttctcaggaaacaatagaaaatgtgagcaaagatgaaaagctctaccctgcagcattatttgtaacagtaagcacttgaagacaaacaaaacattattattattattttttttttttttttttgagacagagtctcgctctgtcgcccaggctggagtggcgcaatctcggctcactgcaagctccgcctcccgggttcacgccattctcctgcctcagcctcctgagtagctgggactacaggcgcccaccaccatgtctagctaattttttgtatttttagtagagacggggtttcgctgtgttagccaggatggtctcgatctcctgacctcgtgatctacctgccttggcctcccaaagtgctgggattacaagcatgagccaccgcacctggtgacaaacaaaacatttaaaaatagttggctggctgattatttgatttgatttgatttttattttgatttttttggagactgagtctcgctctgtcacccaggctggagtgcagtggtgtgatcccagctcactgcaacctctgcctcctgggttcaagtgattctcctctggatgaatatttttagtgctatcattcactggaatgatgtcgccactaaaaaattttatttacaaaataagtttattagaagttatgatggctggacgtggtggctcacacctgtaatcccagcacttttgggaggctgaggcagacaaatatcttgagctcaggagttggagaccagtctggccaacatagtgaaaccccgtctttattaaaaatacaaaaatgagccaggcgtggtggcacatgcctgtaattgcaactactctggagactgaggtgggagaatagcttgaacccgggaggcagaggttgcagtgagccgagatcgtgccactgcactccagcctggggaacagagtgagactctgtctgaagaaaaaaaaagaatcatcctgactttccttatagagagggggagggcagagagtttgtcctgtgtctcctttttctcaaagaaaagaagggacgtccaccaaatttttagcagcatttcccactgaatgactgcattatggcaatccttattatgaccctgttttacgagttttctacaacagcatgtctatgtttacaatcgggagaaaagtggtttttgcttttgctgtttaatatctaacatgtgttgtgacctgtccctggccaacttgttaggcgtggagataacatagttgaatgagaggtggacagttgctctcctcagcttccgtgtggggtttgccccttccctgtgttaatagttgctttaccaaaacctttcaggactttttttttttgagacagggtctggctctgtcacccaggctgagtgcagtggtgccatcatggctcattgcagcctcaagcccccggccccctgccaggctcaagcaatcctcccgcctcagtctcctgagtagctgagactacaggtgtgctccaccacgcccagctaactttttatttttttgtagtgatggggttatcaccatgttgcccaggctggtttcaaactccaggacacagtctgtcctcctgcctcagcctcccaaagcgctgggattgcaggtatgagccactgtgcatgaccaagactcttcaggatcctaaatggtttcagcaacaaacattgtttagttatgtaactcagaactccagtatggacatactatgtgatgtgattttattattgcttatatgcttttgtggttttattgtttgtttttctgtttgtttgttttgagacagggtttttgtttttgttttgagacagggtcttactctgtcacccaggctaaactacaatagcatgatcctagcttgctgcccccttgaactcctaggctcaagcaatctttctgtctcagactaccaagtagctaggactacaggcatgtgccaccatgctatgttgtctggctggtgttgaatacctggtctccagtgatcctcccacctcagccccctgagtagctagcactacatgcgtgagtcatgcctggctaattaaaaaaaaaaaaattaagagatggggtcttactatcacagcgtgaatcccaaaattggggttcagtctgggaggccacatgggttcttggcttcccacaagaaggaattcaagagtgagccaacaaagtaaaatgaaagcaaggttattaagcaagttaaggaataaaaggggggctactccataggcagagcagtggcatgggctgtttgattgagtatacgggtattccttgatcatatgctaaacaaaaagtgaattattcgtgagttttctgggaaaaaggtggggagttcccagaactgagggttttcccatttcagacaatatagggtaacttccagacattgccataacatttgtaaactgacatggggctggtaggagcgagtgtcttttagcacaacagtgcattatcattggcatataatgagctgtgaggacgaccggaggttgctttcatcgcatcttggttttgatagatttgggctgctgctttactacatgtcattttatcagtggtgtctttgtgacctgtaccttgcaaaccagtcctgaagaactcttgtctcatcactgtgttgtccaggctggtcttcaagtgatcctcctggcttcagagtgatcctctcacctcagcatcccaaaatgctgggcttgcaggcttgagacactgagccagaccctgtttattcttgaattgtttccagtgaatatatctcatcgtctccccccaaaaaaaggttgcaagtttttggccaggcgcggtggctcacgcctgtaatcccagcactttgggaggtggaggcgggcagatcgggaggtcaggagatcgaggccatcctggctaacacggtgaaaccccgtctctactaaaaatacaaaaaaaaaaaaaaattatccaggcttggtggcgggcgcctgtagtcccagctacttgggaggctgaggcaggagaatggcgtgaacccaggaggtggagcttgcagtgagccaagatcgcaccactgcactccagcctgggcgacagagcaagactccgtctcaaaaaaaaaaaaaaaaaggtggcaagtttttataaaaagagaaaaatcattcttagtatttctttaataccctctacattgacctcactggtgcaaaaaatattagtttgctggtgaaaattcacctcgagttactaaatatctaactttcccataactaccatctgtttgtctcttgtggatctgtttgcctaatatttaaatgacccattcttccccacttttacgaaaatagcattaattcccctttcactattcacacttccttcatcgtcacagtttgaccagcggtccagggtttatgatctcaagcatggccatatatatctatttcacttaagactctggaaagagcataaaatcagatgtaactgtttcctatttcatataatagggaattccatctctaaagttatgacatttggcctttcagtgggtttttgtggtttttactatggctgtgcttagattcctttttgaacacttttccagtggttccacttgaacacaatctttgagtcacataggagaggtgacatgatagagtgtaaagccagaaagagcacgatttggatctcagctcaactgatagggatccgtagcaagatacttcacctctctgagcctcagtttcctcatctgtgcaatgggaatcgtaacgcctgcctctcaatgttgttaagattaaatatgttggccgggcgcagtggcttacgcctgtaatcccagcactttgggaggccgaggagggcagaccacctgaggccaggagttcgagaccaacatggtgaaacccctgtctctactaaaaatacaaaaattagccaggcgtgctggtgcaagcctgtaatcccagaaactcaggaggctgagatatgagaatcgcttgaacccaggaggcggaggttgcagtgcgccaagatcgcaccactgcactccagcctgggcaacagagtgaaactctgtctcaaaaaaaaaaaaaagattaaatatgtgtacagtacctgtaccatgttaggcggtcagtaaacatttgtttaactaacaactgataaggatagtaaagaagtatcagaacacccacctagttatcccaaagggcaggaagagtgctaggtaatggatatagaattccttttagagtcaaattacacgggcaaagatcagcccctccttcaattaaaaagccaggggcagggcgtaataaggaagtggttctccttctttaagcctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggtaacaccaggaggcaccagtcttcatcctcagcctttgcaggaggacacagcctggtctttagctgtttgccaaatgaggcagtctaattcagggagctctttactgggtttattacaaagttcttatcatgtaagtctcaggacacaaaatgacattgagaatctagtttagcggggtttccaggaaagacgaagaaaggttatttaggtttctctttcatttctcttttgctacaaagggtttgggacattcagttaagaacacattactggttgaggtatgtgacgttactcagtcttctctgcttatgtatctggggaggtatgcaatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggtaaatggaagacccttctctctcctctctcccctctagaaagctccctcctccctgagctccctgtccccttctttccacaatcagagcctcggaccttctgtttggtgaatatgacctgaggctctgtctagcattcagcttctattgtgggaagttaaggcactttctctcattcctcatttcacctttagtattaaagaacagtccaggcagaaggcacgaagagcctgagaggtctgaagtgagggggagaggagaggggcagaaggggaggctccggacaacagaaccaagctgagcttaggatgtgctgtgggaggctccgtggggatgagtgtcagtgcccacgagatccactcaggcctcaactgtgtgtcctgagcacatgaagtcagctcttctgctgggacagccaccaagggattctccacacccctcaccgctgggacaggcagaggcacagcgaaccaggtgtccagcgtaactggggcactgggtggtggccgcctctgtgtgtggaaacacgaggtgcttgctgcagtttcctctgtgtgcttatccgttagctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcctcacaggtctcacccaggaacggaaatctcccctccaggttctgaaccagcattcagaggccccacccagggcttctgtcaacataagcataaaacttatggtttacctttccataaaccccaaagttgggcttcttgtatagagtacaatttctgtaggaagagctgaaagcagaagggatctaacctgtgataatactcgatcgctgctgcttgaaagtaagacttagctatacactgaacaatcaagtaatttataacaaggattagaggaaacaaaaactctgtgtttgtgtgggtgggtttttttttttctttatttttgtttcttaagagagtgtctccctctgccacccaggctggagtgcactggcgcgatcatagctcactgcagcctccaactcccaggctcaagcgattctcccccctcagcctcccaagtggctgggactgcaggtgcacaccaccacgcccagctaatttttttcattttttgtagagacggagccaaggctggtcttgaactcctgggcttaagcgatcctgctccctgggcctcccaaagtgctgggattacaggcgtgagccactgggtccggcatctacatttgttaaatacattaaaaccctcttaatcctttgtctccgtttgttctcttttgctccctgctctccaggctcttgtggcggaggcccccgctccctccgctgtagggtagcctccttctggggctggctcctgagcactgttctttctcctctctctcatcctctctcattcttagctttgcctgtcgactgggccaagtcacagcctttctggcctgtaagacaacaaaaatctcacattttactaaatggaaggactaagtactctgtcttgacttcagtggtttccccgatttctgatgttgctgctgaaatagcattagcaagcttgtttcttaaagaagccctctctccagtgacaatactccccccgccacacacacacacatgcacacgcacacacaaacatgcatgcacgcgcacacacacacacaattttaaagccctcgtgttatattaaaaaggtctggatgtttttaacatacatggaaatttcttcagcagcacagtgttactggtctgacgagggcgcacagcctcctacccaaggacacagttcctgaaggaccagggtgcacatctggcctgcagtgccctgagccactctgtccaaaaggaagccttgaatcaaaagcctcatgaatcctctcctgagaaattccatgtctggtctcttgctagactcagccttttccccaccaagtctgccgcacctaattctgacctcaccctgcttggtggcccgctttgcctgcttgcacgcacctcaggtctcagtgtgtctcagcaacagcttcccctcctagggtggccagagttagcaagcaagaatgcaagacagccagttatgtttgaatttcagataaataacaaatataagtgtcttttagcatataatattttatttgggacatatactaatatttattatatattagtctcatgatatttgggacatatactaaaaaattatttgccctttatctgaacttcaaatgtgaccaaatgtgtcctgtattctgaatgtgtctggcagtcctataatcattcattcagtcagtcatcagatatttgagcacctaccatgtatcaagcactattctagagagcccggatagctcagtcagtagagcatcaagcgctactctaggtgctggggaagccagccaaagtcccgccttcatatcttacagtatgtctactttgtttttatatacatgtacactatatatacttgaagatatgtacctttttctttttttctttttattatttttttttgagacagagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcggcctcccaaagtgctaggattacaggcgtgagccaccgcgcccagcccagatatgtactttttaatggcaatgttaccacatttaatgagattatctttttaaaaaatgttttaatttttaaattttaaaaaatagggatgggatcttactttgttgcctagactggtctccaaatccaggtctcaagtgatcctcccaccttggcctcctaaggtggtgggattacaggtgtgagccacggtgccagccaagatgatcaatacttccttaatatcatctaaaacatacactgtactgtgtttagttctctatcatctcaaagatatctacatctttatacagtatgtttgaattacgatttaataaagatccactcatgacatctaattgatgtctctttttttttaatatgtttcttttttttctttttatttatttatttatttttgagacagagtctccgtgtgtcacccaggctggagtgcaatggcgcgatccccgctcactgcaacctttgcctcccaggttcaagtgattctcctgttgcagtctcccaactcactggaattacaggcacctgccatcatgcccagctaatttttgtattttttttagagacagggtttcaccacgttggccaggctgctcttgaactcctgcctcccaaagtgctgggattacaggcgtgaacgattgtgccctgcctgatatgtttctattctttctttctttctttctttcttttttttttgagacggagtttcgctgttgttgcccaggctggatgcaatggcgtgatctcggctcactgcaacctccgcctcctgggttcaagtgattctcctgcctcagcctcccgagtagctgggattgcaggcatgtgccaccatgcctggctaattttgtatttttagtagagacggggtttctccatgttggtcaggctggtctcaaactcccgacctctggtgaactacccgccttggcctcccaaagtgctaggattacaggcgtgagccatcgtcccctgccggatatgtttcttatgtctcttttaagctgtagcagttctctgtcttcacctttttttggcgccatttatttgttgaagaaaccggccatttgtcttgcagaacttaccagatactgaatttggatagctgccttcttgtggtcattagtttatttctctgtcccctgtatttcctgtaaactgatcattagatccagaggcttgatcagattcggatccaatgtttttggatcaggagacacataatggttgtctcacctttagtgagaccaagattggtcattgggaacagggaagtggagctggggtgagtatagggtcaccagatgtccagtacaagcagaatggacagggctgtgctgcaggatggatgaggggagggtgggatgcccggaaaatgcatgggggagggtgggatgcccggaaaatgcatgggggagggtgggatgcccggaaaatgcatgggggagggtgggatgcccggaaaatgcatgggggagggtgggattggatggaattggggagcgggaaggggtaagtggaaaagcagtaaggaacatgaccttcgaggagacactgacgtgactccttacagagcaaacgatttgcatgtaagtgaaatgcatgtaagtgaatgtgaaattggagcagtggcgggaagaaagattgtccaagccctggaataagacaggaatgtgaagaaacagcagaggaggaggaaggattgcagtcatgacccccacttcatgccatactcctcaagcatttgcttacatccagttatgtgagggaggtttgcggggcttggaagttgtataattgtatctgtgtagttggtctggtgggttttgcaacttgccctttgctgcactgggagggccatttttgtcccctccagcatcacctgatgttgcagcatagcccgctgcatccctcccaggctcacttccatcagaacgcacctagccagggacccttgctttcctggggcctggccaaggagcagttcctcagatcaacagcttcgctatcagccaatgtgagcctcttctaagtaaaggagaggagacagtgatggaaaaaggcagcatccagcaggccctcaggggagatatttcagctcctacacctccttccaatagcagaaccagggggaaaagttagagaatatccttattctatctaacaacttggacaccgaggaacaaaaaggtggcgtgacttgcccaaggatgttgcaggttagaagctgagccagccgtggctatccatccttcagacacccaggccaacttgtctgtaccacctcacattgcctcaaaccctgtctgcagttactgtcccatttctttatcatttggtcctggtatgacaaggtacagtggaaagaaaaagaggaacatgccagccagtccccttaatattactgcagcttctttatcatcacagcagcttacatgccgaaagaccgtcttaaattaggaccagaaagggaagggaacattattaagagccatattaagacagagcctgaggccgggcatggtagctcatggctgtaatctcagcactttgggaggctgaggcaggtggatcacttgagcccaggagtttcgcaccagactgggcaacatagcgagaccttgtctctaaaagacaaaacaaaaaaattagccaggtgtggtggcatgtgcctgtgttcccagctacttgaggggctgaggtgagagaatcccttgagccggggaggttgaggctgtggtgagctatgatctgcactccagcctgggcaacagagcaaaactgagtctcaaaaaaaaaaaaaaaaagagagcctggggcctaggacaacagctgaactagaaaaaaaacatagctaccacttttgaaccaggttctgtgcaggaacttctcttgtgtatcttacacccttacaatatccctgcaagatgactattattatttacaatttgcctgcaggaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgtaagctcaagcaaaggaaattgaacaaaatcagttctttatctatcctgttattcgtatggaaataaagaagaaatgcttgcatcctgttgttttagtgcttgtactgatctttttcaaacatgcctgtgatcacatcactctctactcaaaactttgaacagctctccattgcctccatcagtgtgtttcaaattcgtaaaaagtaaaataaaataacaggatgcttttttcagatgaaatcttacatggcataccaaatatagcaagaaaaaagaaagagagagagagaggagagagaagccgggacaagctaaagcagagggtagagggagaaggaaccgaggaagggaagggtcaggtcccaggcatttctcttccctgaattggcctccctcttttgccacctccccagcaagacctttaactccacagtccacagctcattttgaaatgtactgatcaacgtgagaaaatgcgaagcttcagcctgatagtcaaagaccaccataatctggacccaagtgctagttcacttattttccctccactattttcaagccctggctatttgcaaactgcatacgtatgctgtcccagttctctcaccactcttcaaacacattctgaattcacctataatctcccctctgcccgccctgttgtagccccaatatccacccacctgtctaactccttctagctttccaaaagctttcacttgcctctttctttgaagctcacctatccctgccttctaacctggctatctgcatctctgttagacctcttacttagttcattagttcattctctctctgttgttttttgttttttgagacggagtctcactctgtcgccaggctggagtgcagtggcgcaatctcagctcactacaacccccgactcctgggttcaagcgattcttctgccgcagcctcccaagtagccgggtctacaggcgtgcgccaccatgcctggctaatttttgtatctttagtagagacgggctttcactgtataggccaggctggtcttgaactcctgacctcatgatctgcccgccttggcctcccaaagttttgggattacaggcgtgagccaccgcacccggcagttcattttctttatgtggagttatctatggccatgtctctcttcccaccctagtaagactgtggcttttccctctctaccctccagcacaaacacaatagatgttcaataaatgtttcctgagttttcacccctgtctctcctaacctgcaaagggtaagtggccctgcatagaagggcacagtgtggactttgttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaaggtaggcatctgggatttctttctctcccgcttcctggtttttcccttctttgtgtccagagtggtacatctcttctcatgttgtaaagtggctttagagaaggcatgcgttgtgcctcagctttccaacttattagtgttcaatcataattgccctgcttttctcaagactaaaaggagttgctgcctgggcgcggtggctcacgcctgtaatcccagcactctgggaggccaaggcgggtggatcatgaggtcaggagattgagaccatcctggctaacacggtaaaaccccgtctccactaaaaaatacaaaaaattagccgggcgtgttggcgggtgcctgtagtcccagctactcgggaggctgaggcaggagaatggcgtgaacccagcaggcggagcttgcagtgagccaagatggcatcactgcactccagcttgggtgacagagtgagactccgtcaaaaaaaaaaaaatgactaaaaggaaatgatggaagttaagggtgctgggactggttttctttctccactgtctataaataagcttgtttcccaaattcctagtcctctgtaccagacaccaatataaaagaaggaggctaggcgcagtggctcatgcctgtaattccagcactttggaaggttgaggtgggcagatcataaggtcaggagttcaagactagcctggccaacatagtgaaaacccgtctctactaaagatacaaaaaattagccgggcatggtggcgcatgcttgtattcccagctactcgggaggctggggcaagagaatcgcttgaacctgggaggcggaggttgcagtgagccgagattgcatcactgcactccagcctgagctacagggtaagactttgtctcaaaaaaaaaaaaaaaaaagaacgagccctaaccaggggcttgcttgggctgcctgggccgctgctcttcctaagtcaactcattcgctcagggcctctgtgtttccatctgtacattgggtaccccactctctccacctcgtatggttgatgggaagatcagagagcaagagtaaaaggactcttgacaaagtacaaaccatcctacaaaaacaactgagaagcatttagacaaaatcttccctcagttggacaaaattaattgtacttaatgaaacattttcaccaggcactgaggctcatacctgtaatcccagcactttgggaggccaaggtgggtggatcggttgagctcaggagttcaagaccagccttagcaacatggcaaaaccctgtctctaccaaaaaatacaaaaaaattagtcagacatggtggtgcacgcctgtggtcctggctactcgggaggctgaggtgggaggatggcttgagcctgggaagtagaggttgcagtgagccaagatgatgccactgcactccagcctgggtgacagagtgagagcccatcacgtcgatactctcagcactgtgggaaaccaaggcaggaggatcacttgacaccaagagtttgagatcagcctggcatcatagcaagaccctgtctccattaaaaaattaaaataaaaaaattagcgaggcatggtggcacatgcctgttgtcccagctactatggaggctgaggtggaaggatcacttgagctcaggaggtcaaggctgcagtgagcgaagatcacatcactgcaccccagctctgggtgacataatgagactctgtctccaaaaaaaaaaaaaaaaagacagttgcccttcatgcgcacaccttggcataagcatcttcttccccttcaacaaagcccagtgcccaaagcccagattttttttttttttttaaggtgttttagatggagtcttgctctgtcgcccaggctggagtgctgtggtgtaatctcggctcactgcaagctccgcctcccaggttcaagcaattctcctgcctcagcctcctgagtagctgggatcacaggcgcgcaccaccaggcctggctaatttttgtatttttagtagagacagcgtttcaccatgttggtcaggctggcctcgaactcctgacctcgtgatctgcccaccttgggctcccgaagtgctgggattacaagtgtgagccactgcacccagccgcaaagccagattttaaaagaaaggccccctcctgctgagtttcattggcctgggtaacttgtcaataattagtcaagaggtggcagtaatgtctcagtttttaaatgtgacagtcctggcttgcttggagaatcagcccactcatagacagctttagatcactcactatgatcaaggaaactcccttttcccattagagtttcagatgtttagaacagtgggagttatggtcaggatcatctgagggaacctcatggcacagacaggatgaggaaatgggagtcccacaaaaagggcttaccaaggaaacatccaggaagtagcagagcctggactcaccagaagtccaggcctctccctagacttgtttcatttttacagcaaggcatctgctctctgaactctgcccagctagggcaggtctagggcaagagggagcggccccctgtggtccttccctccacatctgcctccccacccctcagctgccctcacccagccatggcttcttctgccgggggtggcatctgggctctggggcaaagaacagtttggaggcacctaaataggcttttctacttggcctgtactgtggactttgccagcagacagagaaagcttttacagaccttagtcttctggtttttcctgagataaattgcattctgtatttcagtatttactggagtgtcatttgacattttttttattttctaaaatttcaagagaagcttttatttcttttttcagtagggaaagaaaacttttatgtgagattgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtcggttttacattgagcgtgatccaagagagcctcacattctatttctattttgccacatacaaatcaggccttgcaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggtttcatcgtgttagccaggatggtctcgatctcctggcctcgtgatctgtccgcctcagcctcccaaagtgctgggattacaggcgtgagccaccgtgcctggcctcacctgggttattttaactgtaagtcactatgtagccttgtacagccactgccaggcctcagtaccgggcttacatgggaactgtgagattatgtcccaagaccaaactctgttaggaagaggcctcaggatgcagagaaatggacaataacaccagttttaaagactaccaacccaggctctttcacttgtgaatcttttgtttctccatagctacgatttgctcacgtggaatgttatagttaaggtgaggttcagcgatatacagtggaacactcaaatacccatggcttaaataatatacaggtttgcttttctctcctttaaaagaggacaaaagtttggcagctcaggcatgatatgacagctccacaaagttattaagaatttctgggaatggccaggcagggtggctcatgcctataatcccagccctttgggagtctgaggtgggcagatcacttgagccaaagagtttgagaccagcctgagcaacatgacaaaaccccgtctctattaaaaaaaatacaaaaattagccaggcgccatggtgcgcgcctgcagtctcagctactcgagaggctgaaggaggagaatcacttgagcctgggaggcgcaggttgcactgagctgagatcacaccattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaaggaagggcaaagggtgccttctttctaggtaattcagctcccttttattttattattattttttaatcttttgtaaagatggggtctgtgttacccaggctggtctcgaactcctggcctaaaatgatggcctcgccttggcctcccaaaatgctgggattacgggcgtgagccaccgcacccagccttagctcccttttcgagagctttcttgaaactgcccccagcttctgacatctcattggcccttccctactgcaagggagcccagggaatatagtttgttcagctgggttcattgctgcccctcacattttagaggtctgttactaaggaagaagaagaaagtggatactgagtgggaaagagcagtccataaggaagtcacaccccaaccccctgccctttctctttaaaacaaatgcctcagaccacaggcgaaatgggaccttccgaccctgttggcctgctcttcctggcgccacgatgacccccaaaacagactccaaggaacagacagcctttctgtcttctccccaccccatccagtgttccctcgcctatcagacaggaccaagtctgacaaggatataatcttttctttttcatgttttaaaattaaaatatccaagatgggaattttaactagagctagtgcatctgtgggaacatgtttgcttatagtttctcctggacatgtctcactccatgtccacaaacccacagaaatcaataccctgctgtaaccccagcactttgggaggctgaggcaggaggatcacctgaggtcaagagttcaagaccagcctggccaacatggcaaaaccctgtctctactgaaaatatacaaaaattagctggacgtagtggcgggagccactacgtcctgtaatcccagctacacaggaggctgaggcagagagaatggcttgaacccagaaggtggaggttgcagcgagccgagatcgtgccattgcactccagcctgggcaacagagcgagactccgtctcaaaaaaaaaaaaaaaaaaaaagtcaataccctgtacacagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagatagcctcttgccatttctttctttgccaggggccatgggtggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccaccttggcagctgcatatgatgtcaaaacctgtttctcttgtggctcagtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagaacaacctgggcaacatagggagaccttatctctagaaaaagaattttaataaattagccaggcgtggtgatgcacacctgtcatcccagctactcaggaggctgaggtgggacaatcgcttgagcctgagagatccaagctgcagtgagctgtgatcacaccactgcactccagcctgggtgacagagtgagactctgtctggaaaaaagtaaataaacaaataaaaggttagaacttagtgacaaatcaacagtgaaaattttaccacccagcaactcagccatgccatctgcccaccccacctcccctcttccccactcaggggcaaaggcgactggtctcttataggctacaacactcactgggccaatgccatttcaccgtcctatctcaaagtgctttattctacaattctgtatgcaaatacatgacgtaactcttttctcagcttgtaaattcttgaaggccgtaagttgtgctgactgcatccttgtttacctataagcattcattgaatgttttccagtagacatggagaggagagaagaggcagaactgtaccagcaacgggagttaggtgttcacttgataatggacttggatgatgaatctcattgccctgagagcagggatatttctttcttcagtgaccaaccccgaaatgcttgtcaaattatcgaatgtcctcctatgcatgtaggggctggctcttagaggtataaagcatgtcgagaaaaaagaataaaaataaaagcataatgagcattccttcaagtaaagagctaagcactcctttttgtgtctcttcccttgcaaaggggaaaggagaccctaattttgcaagacttcaaaaagagtgtgcagaaggccaattgtttcaaggtgacaatcattcctgcatgcacccctcccacatcccggcctctgccaggcaactttcagtcctttctgaagaatgaccctcccccagcacacatactcccaggcagtttccttctattctggcctggtcttttcattccaggcaactttgcataccaatgagccagatgaagttctgggaagggcctctcagcaccattttgtcttgtttcagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaaggtaagctttccttccctgggtggagtgtttgccaggcaggggcgcaggagcatttgtgtatttatccatcccagggctcggcaacttgacagtctccgctgcctggactgagggcttgacagccacaggctgtgggcaatgagctccagcttgagacaccagcccaaggcaagggggctgccccagcaggttgaaaaaacattcccagctctctgctaagtaagaaaggaaagtctcctacagagggagaggaggaaacacaaagcccgcattcagccttgtctgtggcggaaaatgcaatgttagatctgatcatgttaccagtgaccctgggccaatttgcatcaggtacagttggagcgtcaagccagggatttatattataacattgctttagggctttgtgaaaaagcaggggttgtcaggcaccagctatggtgcaagacatggagcagaactgagaagtagtgacaaggctgggtcagttgtcacccaaaccatagcaatagctgagactgtagatcccatcaggctggtggtaactcaaggcactgaggggagagtcaaggggagcaaagccaagtgccactggaagagaagctctgcccggcattcccccaccacagttcttgctcctggctccctccacaaactacagtggaggttgtgatgacgcagcctcattgtctgggataaatacgtgaggttcgttgtctcatgccaagggaatcgaggacatggacacacacaagaagtgagtttagcggcagaggtttaataggcaaaacaaagagaaaggagaacagctctctctcctgcgacagagaggggaacccaaatgtgacttctggcctgcgacagagtgcaccggattttatagacaggtttgaggaggtggtgtctgatttacataggatccaaagatcagttgaaccaggtgtgacgtttacatagcatgggggaagctggccaccccaccctcatcttattacgcaagtgggctttccacttgcccagcgccatgttgtctgctccctagggcacacgtggttggaaaggaaaagggaaaatgcggccgccatgttggacatgcctagtcccaggtggccttttcctattggcacagctgccaacattcactgtgcaagcttttagcttgcttgtctatgtctgcagctcaattttacaggctactctttgttagaaaagaaaatgatttggggctgcttttcattaaaaggaaaaccttcccgagaacttccttaccctcactatctgcctaaatcatttctttttaactcctctaacagtgaggccaaggtggatcttgggtttgcacctccctaaagaacaaggtgaaggttctccctccaaaggtatccgtgtctcccaaccccgatgcagagcggtagccacactaaaggggccacagctgccacagaggctcaggggaccgtgtgaagagctggaggagaggaggaggcctctgagtctgctaaaaaaaaacagtgtgacattttattactatcccacatgggcttgggagatggaatgccacccctaaaccaagctaaagctaagatgacctcatcctctgtgcacaggagaaatacaggcagctgtgccagcaactttccctaagagagtgttaacccaatatatcgagacagatcttactcagtgtagaacttttattttggccgggagcggtggctcgtgcctgtaatcccagcactttgggaggccaaggcaggtggatcgcctgaggtcaggcgttcaagaccagcctggccaacatggtgaaaccccttctctactaaaaatacaaaaaaattagccaggcatagtggcaggtgcctatgatcccaactactggggaggctgaggcaggagaatcgcttcaactggggaggctgaggttgcagtgagccaagattacgccattgcactccagcctgggtgacaagagtgaaactccatctcaataaaaaaaaaaaaaagtagaagaagaaggtttattttgccaagcctgggcacggtggcttacgtctgtaatcccagcacttcgagaggccgaggcggacggatctcttgaggccagaagttcaagaccagcctggccaacatagcaaaaccctatctctactaaaaatacaaaaaaattagccgggtgtggtggcacacacctgtagtcccagctactcgggaggctgaggcaggagaatcacttgaacctgggaggtggaggttgcagtgagccaagatcgtgccactgcactccagcctgggtgacagagcaagactcacatactccactgcaccctgtccccccaacacacaccatacaccaaccgtggccacgttcctatccatctgcccttttagccttggccataggggaatttattaattttacttatttatatcccaccttattgtcaagacccagcatacaaagaataaattttagtcagataaaatccatcaatctgaaagatatctttgtaaaaagaaaacaaaaacaggaaaataagacggatttgggaattaggttaatttccaaaatgtaggccagcaagactatccactctcttagatatgggccacaaatttggctctatactttctagcaactaacccaaagagtgaaatataatcaaatatgagatttatggtgtccataagataaaagcaccatctgctgaggaaaaatccaaaaaccagaagaatattccccctaaatatcttcatagacagaatcctgtgctgtgaaaccgatgtcttcaacaacaagcttaaggtaactacagcgatgaatttcacagtgagagctgggggactgagcaaaggaagaaggggaaagaaggaaaggaaggggctgtaggagaaatccctagtatggtttgtgtctgggcagaagaggcgaggtaagatttacttgataagaatgaacatgcttcttgccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaataaaaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattccctttctaagtcctggtttctacttagtcctaaattttatttcccttggagtcaaaattcttcatgctggtagaatctcaaaaatgagtcactttggaaaacataagtaaaccttctggagcctccttggaatttttggaaactaaaaaagaaacttgttattgcaagaaaagacaccagtaaattaaaatttgctggatggaattattaatctcattccccatgtaactgatcctcattgaagtttagactcgcatttgctttgcagcctggatatctgtgtcccacagttgctccaaagctggaatactttctggaatctttttcccctgtagttgctggactgttgcctgtttaagggctctcttagcagttcagccagggaggtgcgctagtgttactgggagaatgtatggatttcctgccatttggaagttgagacccatctttccaatcaggaacgggtgagagttgccttcaggtaaacagttggtgagcaaaccttcaacagagtcaaaagggcttctctatgcctcctgggtccataacccacagacgactgagtagtctctagaatctgtcaatcaggggctggcttgcagacatagacccttgtttttccagaatctgtggggagggagtcagaccctgggggtggggatgggaggttctgcaggaagacaaacagctcctgtctatagctttgtcaaaagtgtgcccagaggctggtgacccagagggcgaagcacctgggagatgggacagaatgagaaacagcgagaaaaccagggatattaggttaaagaaaagagaacggggtgtgtgagctttgggaccacaagtagagggtggagaggggtgcagaggaagcaagagatggaacaggatcatgatttaagggcacccctgcatttctccagagctagtgtcatggatacacaaattatgcctagtatggggtgattgatttctccttatggtaagaatgaacctccattcctggagaataggcattccaggctgcccatgagagtcaacgggtgccttgtgagagaatgatcttcctgtcacgggaagaattgcaagtaggtgccaataccagttagcatttcagcacagaactccgaggggtcctttagacaacctcaagggctctttacaactcagagtttctgtggctctcacggcaacctccttcccagcttccctaagcagggacttgtggtcattggtcagggaggtgggaaaggcggagtgggggtgctggaggtgggacgaaggccaccgatctcaggttatgaagagcgatggtttcattttcacccccacaaattaccactttcaaaaacctcactttgcctggtgctctctcttaaggagtttggacattttacattgcttatggcaaagccttggttgttatttcctttacatgcttccccagtagggagctctgctagagacacatggtaggtgtgaccttgtgctgggcgggtgccaagctcccactgcagagtgccgtgtgtgtggctgcaggggatctgcagagccgctggtcccaagagcacacacagcccgaaggcccatcctacacctccaggagaggccaaagagccaggtgcacccgagagggacaggcaggggaggggtgaggaggtgccagtggaagccctgtctttgtggcgtttgattcttttactgttctggcacagtccccacttggctgcctgctagggttttgagcctggcctcctccattgggaaactgatgaagaggagtctgttccctgttatggaggaggctggccatgcctcctgcagagtcacaacccagacggggcctggacggtgggggtgggcgtggttcagggaaaagacaggtctgccaaaatctcccaatcgcatctgactcatcccccagatatcccttttagaaacaatatttgttgaaaacccgcttggcttatcattcctctaggacagaactagaggattttcaaataaatattttgtccctgctcactcagaaatttccgttttcacatgacaaccagcatattaacagacattgcaagaatgctttaaatgaagatgatatatagctttttgatatgagccctgatttttcaaaagcagaagaggcagcattgattttgttttaaaggcgtggtagttcaaaggaggtaaagcagagagataccaggttcaagggaaggccgggaggtaaaatcaatagggtagaataatgggaaagaaatcaatgaattggagtttttttaagtgaacattgcatgcaagggagtcttccctgacctccatgctcccgtagcatcctgaaaaatgactcgcatttccaaagcacctcttctatgtccagcactataaagtgttcaactaccctatagtatagggccaagcacagtggctcacacttgtaatcccagctcctggggaggccgaggtgggaggatcgcttgaggccaggagtttgagaccagcctgggcaatatagtaagccttgtccctaaaaaacaataataataaaagtttcttaagaaaatgaaggctgggtacgggcacagtggcccacacctgtaatcccagcactttgggaggccgaggcaggtggatcacctaaggttaggagttcaagaccagccttaccaacatgatgaaaccctgtctctactaaaaatacaaaaattagccgggtgtggtggtgtgtgccagtaatcccagctacttgggaggctgagacaggagagttgcttgaacctgggaggcggaggttgcagtgagctgagatcgcgcctctgcactccagtctgggcaagagagtgagactccatctcagaaaaaaaaaaaagaaagaaagaaaagaaaagaaaatgaagactgggtgcagggactcatgcctgtaatcccaacactttggggaggctgaggtgggtggatcgcttaagcccaggagtgggcaacatggcgaaactctatctctacaaaaaaatagaaaaaaattagccaggtgtggtggcatgcacctgtagtcccatctacttgggaggctgaggcaagagaatcacttgagcccaggaggcagaggttgcagtgagctgagaccacaccactgcactccagcctgggcaatgggagtgaaaccctgtcttaaaaaaaaaaaaaagaaagaaaacaattaccctatagtatcaatactatcaccatcctagtttagagatgacaaactgaatctgagaggttaatttccccaagattgcatagctaagtaagaggtggacccaggggtttgagccaagacagtgattcctaagcttcagatcctgtcccttacactacttctagcaaaggacatcacatttttctgcaattcccactagactgtgagccctttgagtgaggacccgcatctcagtcatccatactacctgcccattataagtgctcaggaaatatttgttaaatgtcaaatgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttaaaaacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaaacctgggaggcggagcttgcagtgagccaagatcgcgccactgcactccagcctgggagagagagcgagactctgtctcaaaaaataaaaaaaattaaaaaaaataaagttaccagttccactcctggatatatacccaagaaagttgaagacatattttcatacaaaaatttgtacatgaatgttcatagcttccattagccaaaaagtggaagcaacccaaatgtccatcaactgatgaatgatgaatggataaggaaaatgtagtatagccacacaatggaatgttattccactataaaaataaagcaagtattgatacatggatgaaccttaaaaacattatgctaagtgagagaaagtcaggcaaaaaggccatatactgtatgattccatgtatatgaagtgtccagaataggcaaatgtatagatacagaaagtagactcgttgctaggagctgagggtgagagaatgggaataattgctaagggatgtgaagtttatttttggagtgatgataatgtcctaaaatcagaggcgatgtttgcataactctgtgaatatactaaaagtgaatatacgaattcactgaattagtgaattttatagcataattatatttcaatcaatctttataaaactagcagttctaattctagtaatcaaaaagaggaaagagaaatgaatgcaattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaaatgtatttcttatccaagttatcataaaccttaatcttaactcttggccacagttaagtttaatttggagcatgtcagtggaaattaggagaggggagacaaagaatgtgagagggatgactaatttttccaaagggtagaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgtctcgatggctctctctgctgtccttgtagtagtgtgggaggagagaaatctagtcccatgcacaagctttccagaagctcagggttcctatctcagtattccacatttcatatgagtacatctcatcttcccaactaaactgcaaatctgtaagggtgagatcatgtttttatgatggctcctttaatctcccatagctcccattcctctacataacaccatagatgttcagccagtacttgtagaacggtgaatgaatcgatcaaatgaatgaatagcaactctatctacaaggcatgccaaacaagctaccacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaaggaaagatccagcctgttagctctgggtgtgtaacgtaagaccttagctgatgtcttccttgcaggcataccaagaatgccagtcacctctccaaaccctcccccaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaagagtgtcttctgattagtaagtaataagtcttctgattatcaaatgagttaatttacataaaatgctcagaacacttcttggtacttaatgttaagtcttcacttatggtccctaatgtgtgctgccctcagctaagctgccaatttcctctcctgtcaacgcagtcactgattgctttcctgagattgcggctgttcggtataaggttttttagaaacatgctcaatagtaagtgtttaagacacaaaacaatttaaaaaatactatcaaattataaggtcttacaaatttctggatatgtagtacccagcatatggcctgatgtaaaactggtgcttaataaaactttgaagaacaaacaagtcagtaagtcagacatactctcaggttcaagggaaaactggatctatctattatcaaatgcttcactagcctacccatctcaataaaatgagttattctcttttgttttcttctcccacatgaaagtcatcactgttagggatagaggagtctccattttttgtttgtttgtttgttttgttttgttttgagacagactctcgctctgtcacccaggctgcagtgcagtggcgtgatctcggctcactgcaacctccgcctcctgggttcaagcaattctcctgtctcagcctcccaggtagctgagattacaggcacccgccaccatgcccggctaatttttttttttgtatttttagtagagacggggtttcaccatgttagccaggatggtctagatctcctgacctcgtgatctgcccgccttggcctcccaaagtgctgggattacaggcgtgagccaccacacccagccaggagtctccttttagacatggagacactgaagaccacctcttcctccatccactctgatctcgccattccaaactttttgcagttccccaaaggtattatgcaacctggcacctctgagccttcataacagtatcctctctacttggagtgttcttgcatgatggcttcctttccccctgtttccactaaaacaactaactctagctcatctttccaaatttcctcagtttcctccaggactcatttgctaaccctcccttggccatcatgtggctatatttggatgccttttctcataagatgctccaaatcaccctgcatgtagacattatgcttaatatattgcaccgtaagatttggtttacccagtctttctcagtggattgtaaagtcgtttgcaaacaggtactatgcctaatttaactttatatatctagtgcctggcatagttttggcacacagttgcagaaccataccctcgtctgactgatacagcttgtaaatcagtatgactggaatatgccctaagatatgtgtacttacaacaagctctccatgtgtttccaatatcatctatggcttgtggtcaagatgaagtaactaacgagatttaatctcctgcttgaaacaactaaaaaaaaaaaaagacactatagatgagaatgattttcaaggcattggacattaggtaatttttttttttttttgtatttttagtagagacggggtttcactgtgttagccaggatggtctcgatctcctgacctcgtgatctgcctgcctcagcctcccaaagtgctgggattacaggcgtgagccaccgcgtctggctaggagtctccttttagagaactggtccctgagagatgagactctaagtgagccctatgtttgccctagagtactgcatgcaaagagtttctaggtcatgctggagagaggggaacccacgcagagttcaccagctccctgagtagagaggatagagctaggagtccagaaagatcagagcagctgaagtttgcaagtctgataaaggatgaaagagagaggcacacaaagctccagagacctgcagatatttccccttaggtattcagatgaatactgatcaaaacatgtgcatgaagaaattacccaaggcatggggaagaaccacctgaaaatattaaagggaacgctctccaaagcctacacaaggccatgaatactgcctattttggcaataggtagaatccacaaaacaattttgtctcagaagtggcaaaaattagccctagactaagcactctctggttctgcacaacctaaagattaagagcaaaaacttaaaggattaaactgttaccaaataactgagctgtgttctagaacaaacgcaaggatatctatagaataatcaaaatatccagcatccaacaaggtaatattcacaatgtctagcttctgataaaaaattataaggcatgcaaaaaagcagcaaaatgcaatccatcatgagaagaaaaatcaggaaagctagaatgttacagatgatagaattgttagacattagaactattataactgtattccacatgttcaataagccagaagaaatataacatgcaaagtacacatagaacttataagtatgactcaaaccaaagttctagagatgaaatctataacatctgagatgaaaaacatgctggattggattaatagcagattagacatcatagaagaatggataggtaaacttgaagacatagcaatagatccaaaataaaaaacagaaaaataagattgagggaaaaaacagcaatagcgaattgtggaatgacttctaatgaatggcctatatatataggtataattgaagtgaagattttccaaatttgatgaaaactataaacccacagaaccaagaaattctacaaatgccaagcaccaaaaacagggacagggagaaaactatgccaaggcacaccataaattgctcaaaaccagtgataaagaaaaaaaaaagtcttccaagcaagcagagaaaaaggcatattatatgcagagaaagaaaaattaaaatgacagcaaacttcttggggactaacacaaaagaaacagtaacctctctaaagtatcaagacacacacacacacacacacacacacacacacacacacactataaatgcagaattctatacccagccaaaagatgattttaaaatgtagggaaaatagagattttttgagatgtataaaacctaaaagaattccttatcagcagacctgaactataataaatattaaagaaattccttcagtagaagccaaattattccaaatagaaatctgtatctgaaaaaaaagcactagaaatgataaaatgtgggtaaatataaagaatttttaattaaaagataatatactatttaaaagaaaaaataataatgtgttatggggtttataatgtaaatcaaaatgtataagaataatagtatggagggtgggagacagaaatggaagtgtaattgtacagatccacattatatgtgaagtgtacaatttcacttgaaagtagactgggccaggtgcagtggctcacacctgtaatgcagcacttccagaggcagaggcaggtggatcacctgaggtcaggagttcgagaccagcctggccaacctggtgaaaccccatctctactaaaaatacaaaaattagccaggaatggtggtgcacacctgcaatcccagctgctcaggaggctgaggtgggaagatcgcttgaacctgggaggtgaagtttgcagtgagcaaagattgcgccactgcactccagcctgggtgacagagtgagactctgtctcaaaaaaaaaaagagagagactgtggtaagttaaaaatgtatactctaaacccagaatcaactcctaaaacacacacacacacacacaaactcatacaaaatgtatagctaataagccaacaatggaggtaaaatggaatcacgaaaaataatccataacaaggcagaaaaggacagatgagacagaaagaaaacagcaagtggtctattaaactcaaccatatcaataatcacaataaatgcaatgatatagatattccaattaaatggcagagattatcaaattggattagaaagaccaactttatacacatcttccaaaaaaaaaactttaaatacaaagacatgaacagtcttaggcaaaaggatggatgctttgggaggccaaggtggatggactgcttgtgtccaggagttcaagaccagcctaggcaacttgacaaaacctcatctctacaaaaacacacaaaaattgtgtggtggcgcatgcctgtagtcccagcttcttgggaggctgaggagggaggctcactggagcccaggaggtcgaggctgcagtgaaccacgttcatgtcactgcactccagcctgggtgactgggtgacagagggagaccctgccaaaagaaaaaaaaaaaaaaagtcaaaggatggaaagatgtaccataacacccgtcaaaggaaaatggagtggctacgttaatatcaatccaagtagattcaaagcaaataacgttaccaggtgatatagtttggatgtttgtcccctccaaatcacatgttgaaatatgattcccaattttggagatgggccttgtgggagttgttttggtcataggggcagatccctcatgaatgggagggatccctgaagtaatgcattcacacaagatctggttgttaaagagtctggaattttccccttctctcttgttccctctttcatgtgacatgcctactcccccttccccttctgccatgattgtaaacttcctgagaccctcactggaagcagatgccagcactgtgcttcttgtacagtctgcagaactgtgagtcaaaataaacctctttctttataaatcacctagtcccaggtattcctttacagtaatgcaaaatggactaatacagcagggataaagtcatttaataatagtaaaggagtcaattcatcaaaggacataacaatcctaatgttatgcatctagtaacagcctcaaaatacataaagcaaaaactaatagaattgcagggagcaatatacaaaaatgtttcacaattatagctggagatttcaacatctctcaatgattgataaaaccagtagacagaaaatcagtaaggatagtacagatttgaaaacttggagcattaaaaccaacaacagcagaaaaaaacattcttttcaggtgcacatggacatttaaaacactgaactatcttctggaccataaatctcaataaatttaaaaggattaaagtaatttaaagaatgtttgttgaccacactgtaaataaatttgaaatcaataacaaagatatctggaaaattcctcaaatgtttggaaacaaaacctgtctaaattacccatgggtcaaagcacaaatcaaaagggaaattagaagtatttttaacttaaaaatgaaagcacagcatactagtaattctgagaggcactaaggtagtacttagtgcttcactttagcaaaggaaactttaaagcactaaatagctacattagaaaagaatggtcactaactgatgacttcagcgtataccttaaactagaaaaggcaaatccagagtaggcatgagaaagggaattcaagaaatagaaaacaagaaatagtgaaaaaaatctacaaacccaaaagctggtttgttgagcatatcaataaaaccgctagcttgactgatcagaaaaaaggagaaaatatgaagatattttcagaatgttttcaaaattttgaaaagtagaatgtgtcatgagcagaccaagagtagaagacataccaaaggaaactctcagcctgaaggaaaattatagcagatggaaagtcagatctctacaaaggaataaggagcatcaaacataataaatatgcagataaataaaagtatttttctttacatttaaaagacaattgtttaaagcaaaataataatagtatattatggcatttacaacatgcagaagtaaaacttatgacaataaaaacacaaatgaggccaggttgtggtggctcttgcctgtaatcccccaactttgggaggctgaagcaggtggatcacctgacgtcaggagttcgagaccagcctggccaacatggtgaaaccccgtcactactaaaaatacaaaaattagccatgcatggtggtgcatgcctgtaatcctagctacataggaggctgaggcaagagaatggcttgaacctgcgaggcagaggttgcagtgagccaagattgtgccaccgcactccagcccaggcaacagagcaagactccagcccgggtgacagagtgagactccatctcccaataaataaataaatacacaaatgataggaaaggattctgggaagatggtggagtaggaaacactagaaatctgtctcccacctagacaacaataactcaaacagaatcaatctgaaataactattttggaactctgaagtctattaaaggtttgcaacttccaggcaaaagcttcgacaggtaaactacagttaatttaatcaatttcagctcttagcacaataccagctacctatcccccaactccagtcccatggcaagcaatggtgcacctgttcctggagcagtttgcacacagcttgtggtaagcagagtgcaaaaaaagaaccctgttctccaaatatcagggatctgtgcactgattgctgactcctgctctgatcaaagaggtgcaggtaaagaggtggcagccattgtttgtcagtctgacccattacacctctccccatgactacaagcccctcctcctccagctgaagtgactcccaggaaacttaaaaggcctctgccctctttttctccttttcatttttctccttttcccatttggggagccagaaaatgagactaggattttcaaaagcaactgtatttgggggaaaaatatgaaattgaccttgcatatccaaagagaggcacagactcagaaaagacctcagaagacttaagtttatacctcagggtgatccttggtacagagacagtgtacaacaattaaaaatcaaaaccacacaaacccaaaccacaaaatagcaagccctggggaaggggattaatctgatttccacagttaccatattattagattcaaatgtctatgttttcaacaacaacaaaaaatcaaagcatacaaagaaataggaaagtatgacccaaaggaaaaaaatcaacagaaactctctgaaaaagatctggtggcaaatctactagagaaaggctttcaaacaactgtcttaaagattctcaaaaaagaacaaaaggaacatgtggagaaagtaaaaaaataatgtaaatagcatatggacaaaatagaaatatcaataaagagacaagcaacttaaaagaaaacaaaaagaaattttgaaagctgaaagtacaattaccgaaataaaaaattcactaaacaaatttaaagacagatttgagaaagcagaagaaagaatcaggaaacttggctgggcagggtggctcacgcctgtaatcccagcactttgggaggctgaggcgggcagatcacaaggtcaggagatcaagaccatcctggctaacacggtgaaacaccgtctctactaaaaatacaaaaaattagccaggcgaggtggcgggcgcctgtagtcccagctactcgggaggctgaggcaagagaatggcgtgaaccccggggggtggagcctgcagtgagccaagatcgtgccactgcactccagcctgggtgacagagcgagactccatctcaaaaaaaaaaaaaaaaaaaaagaatcaggaaacttgaacataatgacgcaggatttttcttggcccctttgctgggcttgcagcaggggcacccaacacctcggcctgctgtgctcagcccctggtaggagggagcacatgggcaagcgagtgcagggcttggctggttgctccaagtgccaacacaagagcaagctctatgcaggccccacggccagaccaggtatgttgccctaaggggatcgcaacagtgcccaagcaggggtgccccatgaccccaaatccccagaaggggtgttagtgtgctaattagctcttttagttccactgtccacagcctgatggacggcagcacgttaacagctcagtcagattcttgcccctccctgacccagggctccagaactggcgtggctctgggaccagcttggccccgccactgcttctatcatgtggggaagctgccctccaccgttgagggcagagggccagtgttacagcctttctggccacccacattcagtgagtcccaagctcttgtcctgcatccaagaagaatgaggtcacactgacaattaaagggtggtaaagacagataattttattgagtgaagaaacagctgtcagtggaaagagggtgggaaggtcggattgtctctcctgaagtcagattgtctctctcagtgtggctgaatctgggatttttataggcacaggataagggagtgcatgcttcctggtttgtgagtatgcaagaaaggttaaaatcaaggcaccagtgaaaggtgggcacagtgtaaaaacaattagggaagggtaggtatatgtaaaataggttaagggtagggatcaatcaaaggaaagcacaccaaaccggaagacagtactcaatccaaactgtgaatttgacttgtagcttggcctcaggctttaaactttctttggcttgaatgtggggtttcactggggacctgcccatctgcctaggatttctctgtctcctgcctctatcaataagacagtggaaattatcaagtctgaggaacagaaagaaaaagtctgaagaaaagtgaacagagcctaagggagttgtgagacatcatcaagctgcccaacacaagcattatgggagttccagaggaaaggagagagagagacaaagaggcacagagaatacatgaagaaataatggctgcaaacattacaaatttgaggaaagatatgaatgtaaatatccaagaacctcaatgaattccaagcacaatgaactgaaagagacctaccccgaggcacattataatcaaatgcctgaaagacaatgacagataatcctgaaagtaggatgagggaattgactcatcacatacaaggaacccttagatcatcagcagatttttcatcaaaaactttggatgccaaaggcaataagccaatatattcaaaatgctaaaagaaaacaaaaaaaaaacaaaaaaaaaacaaaaaaatgtgtcaaccaagaatcctatattcagcaaaactattgtattagcttgttctcactctgctataaggacatacccaagactgggtaatttataaaggaaagaggtttaattgactcacagttcagtatggctggggaggcctcaggaaacttataatcatggcataaggggaaacaaacatgtcctccttcacatggcagcaggagaaaaatgagagccaagcaaaggggaaagccccttataaaaccatcagatctcgtgagaacttactatcacgggaatagcatgggggaaactgctcctgtgattcaattacctcccaccaggtccctctcatgacaggtggggattatgggaactacaattcaagatgagatttgtgggggggacacagccaaaccatatcaattatctttcaaaatgagggggaaattaattcccagataaacaaaagttgattgagtttgttagactaggtcacctctgcagggtgaaattaaaggacccttgacagtaactaaagtcatttgaagaaataaagatctcaatgaaggtaaatacataggccactaccgaagctagtattattattatttttttgagacagagtcttgccctgttgtccaggctggagtacagtggcacgatctcagctcactgcaacctctgtctcctggaggggtcaagcaattcttatgcctcagcttcccaagtaactgggattacaggtatgcaccaccatgcctggctaatttttgtatttttagtagagacagggtttcaccatgttggccagcctggtcgcaaacaggtgatctgcctgccttggcctctcaaagtgctaggattacaggcatgagccaccatgcctcaaccaaagctagtattatttggacaagggtttgtaactctactttttgttttctacactttttttttttttttgagacagtcactctgtcgtccaggctggagtgcaatggcgcaatcttggctcactgcaacctctgcctcccaggtttaagcgactctcctgcctcaacctcccgagtagctgggactacagacacatgccaccacacctggctaattttttgtatttttagtagagacggagtttcactgtgttacccaggatggtctcaatctcctaacctcatgatctgcctgcctcggcctcccaaaagtgctggaatttccgacgtgagcccccgcgcccagctcttttttttttcttttgacagagtctcactctgtcgcccaggctggagtgcagtggcatgatctcggctcactgcaacctccacctcctgggttcaagcgattctcctgcctcagcctcctgagtagctgggattacaggcgtgcgccatcacgcccagctaatttttgtatttttagtacagatggagtttcaccatgttggtcaggctggtctcaaactcctgaccttgggtgatccgcccacctcagcctcccaaagtgctggaattacaggcatgagccaccgcgcccggcctccacattgttttctacataatttaaaattctttttttttttttttttttttttttttttgagacagagtctcactctgtcgcccaggctggactgcggactgcagtggcgcaatctcggctcactgcaagctccgcttcccgggttcacgccattctcctgcctcagcctccccagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccataatttaaaattctaatgtgtttaaaataattattagtttatgtttcggggaacatggataaagatataactttgttacaaacaaccaaatggggtggggatggagctataaataagtagattttttggccaggcatagtagctcacacctgtaatcccagcactttgggaggctgaggtgggcagactgcttgagcccaggagttcaagaccagcctaggcaacatggtaaaacctcatctccccactggctgctctgaaaagccatctttgcattgtgcctcgtcagcctccttgctcgccgcagccgcctccgccgcgcgcctcctccgccgccgcggactccggcagctttatcgccagagtccctgaactctcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctaacaggaatgctaatgaggaaaatggggagccggaggctgacaacgaggtagatgaagaagaggaagaaggtggggaggaagaggaggaggaagaaggtgatggtgaggaagaggacggagatgaagatgagggagctgagtcagctacgggcaagcgggcagctgaagatgatgaggatgacgatgtcgatacccagaagcagaagaccgacgaggatgaccagacagcaaaaaaggaaaagttaaactaaaaaaaaaaggccgccgtgacctattcgccctccacttcccgtctcagaatctaaacgtggtcaccttcgagtagaggggcccgcccgcccaccgtgggcagtgccacccgcagatgacacgcgctctccaccacccaacccaaaccatgagaatttgcaacaggggagggaaaaagaaccaaaacttccaaggccctgctttttttttcttaaaagtactttaaaaaggaaacttgtattttttatttacattttatatttttgtacatattgttagggtcggccatttttaatgatctcggatgaccaaaccagccttcggagcgttctctgtcctacttctcactttacttgtggtgtggccatgttcattataatctcaaaggagaaaaaaaaacttgtaaaaaatgcaaaaatgacaacagaaaaaccatcttattccgagcattccagtaacttttttgtgtatgtacttagctgtactataagtagttggtttgtatgagatggttaaaaaggccaaagataaaaggtttcttttttttccttgtctgtgaagttgctgtttatttttttttggcctgtttgatgtatgtgtgaaacaatgttgtccaacaataaacaggaattttattttgctgagctgttctaaaacaaacaaaaacaaaaaaaacctcatctctaaaaaaacaacaaaaaaattagctgcatgtggtagtgtgtgcctgtagtctcagctactcgggaggctgaagtgggaggatcacctgagcctggaaggtggaggttgcagtgagccaagatcgcgtcactgcactccagcctggatgacagagcaagagcctgtctccacaaaaaaaaaaaaaaaaagagaaagaaagaaaagaaaagaaaagaaaaaaagagggagaaagacaaaaccatcaaatttatttaatatgttttatatggtacaggagtcttcatattgaaatgaagacccaaagaaacagataagtgttagtgtgttttgtagtaggtttgatgaagagtagacagttgtggagaaatatgataggacataaagggtatgatctcataataactgggggaaacttagcaagacctaagtttagatttctttgtgacttttttttttttttttttgagacggagtcttgctctgtcacccaggcttgagtgcagtggcgcgatctcagctcactgcaacctcctcctcccaggttcatgccattctcgtgcctcagcctcctgagtagctgggactacaggcgccctccaccacggctggctaatttttgtatttttagtagagacagtttcaccatgttagccaggctggtctcaaactcctgacctcaggtgatccacccgcctcagcctcccaaagtcctgggattacaggcgtgagccactgcacccagccaacactttgtctttagagataagaatgttctcttccaggtgtagagagggcacctctcacacgagagacctgcttaagggaaagatcagaaaacttatcccaggtttataaactgcttcaggtgagaatgatgaaggaatcctgcttccatgatttttctccaattccttcagctcaaaatagtattccgaggtgtcatattttaggtactacgttttgagtcccagtagagaagacacaaattaccaatgtctgaaacaaaaacagacattaaaaggatagagaacgtattttatgtcagtaaatcaacaacttagatgaaatggacaaattccttgaaagacacaagtaactaaagctgacctaagaagagaaaatatgaataacctagattagagaaactgaggtattaaaatttttcctgttacatatgtatctgcagttaggaatcatagcactgcatacttgtggaccctaaccctttccttcccatggaatccccaagaaggaacttcaattactggacaaaagacgagaatcttcaagcctgttcaattgagtaatggtagtgggggagcttttggtaggatgatcagaagtcaaaagacctcaagataatcacttcttgtctgccatgcagcttgtgatgtaagatgggcatcgggctgtctcctttttgacagttattttctttggaaagtgaagcaagggcttagggggaaggaagcatcgaataggtatctccatggaataggataccacataggcgtttgggcttcaatggactctaccttgtaatacaattcattgcctcaaatgcattatgtataagtacctctctagaacaggtattggaattgactaattaaagagtcaagtggtagccagtcgtggtagctcacgcctgtaatcccagcactttgggaggccgaggtgggcggatcacaaagtcagatcgagaccatcctggccaacatggcgaaaccctgtctctactaaaaatacaaacaattagctgggtgtggtggcacatgcctgtaatcccagctactcgggaggctgaggcaggagaatcgcttgaaccacagagtcagaggttgcagtgagctgagatagcaccactgcactccagcctagcgacagagctagattcagtcttaaaaaaaaagaaaaaaaagtcaaccggctcattaaagagttaaggttctgaaaactctacattagggactaataccaagaaatactgagagataaatgagtccagacatgccttgacaattaattacagtggaataaagattaaaatctagacctcaatccatatccttttccctctacccaaagacaacccgtttttctttttcttttttttttttgagacggagtttcgctcttgttgcccaggctggttggagtgccaaggcctcatctcggctcactgcaacttctgcctcctgggttctagagattctgctgcctcagcccctcgagtagctggtattacaggtgcctaccacaatgcccagctaatttttgcatttttagtagggatgaggtttcaccaagtccgtcaggctggtctcgaactcctggcctcaagcaacccgctcgcctcggcctcccaaagtgctgcggctggcgacaacccatttctaatcaaaattttgcagtggaacttttcatactcaaattgggcatttcctgtcaagcctggtcattcatcactttattattctctttattctacaggtaggggtttctctattgaccaggttagtctcaaactcctgacctcaaaagatcttcccgtctcagcttcccgagtagcttacaggctcaagctacgacagctggcaatctttgattattttaagtcggagggcaggaggcgaggaaaggcagcacagtgcctggtacacagtaaatgcaggctagaatgttaataaaattatccttcattttaacttccatattggagaagactggttttgtatgttgactaaatatgaatttgcaaatgcaaatctcaagcagattttctgtgggaggggggactgtgcagattacataatgatataaatggatggaaccagagatctgaggacagtaattcgtcatttgaattaaatttatagaaacaatgcaatcatacacaaggcaacgaattaaaatgaaaactacttaattatttacttagctgaaaacctatctggggaaaaaaggacccaaaacagtttgcagtgtttccccattcgtgagattgcctttccatcaggcaaaccaatcttctgccttttctttctttcatttaactgggaatggcacaacgtgtttctgttttccttctaggaaaaagaatgggaggagtcagcaaagaccaaggtaagttcacttatttgagggcattggctaagggaaaacattttaaaacttggtttccctttaattggtatttgggctcaaatactgcaaaataaaaaagcagctttcctcccttcctatcaaactagtaagctcagtatcaagcagagacctggtatttcactggattttactatgtcctaccctcacagaaaaagaatcatcacatcacactgggctcttcaccaggaaagcaatgtgcattttataagctaatttaagatcctggaaaagagggaagtgctcagagtccatactagaactccttccagtttactgaaaacaagagcagttttgaagcacaggctatttcttattcttgttcccaaacacaaatgctgccagcactgaactaagcaacagcccttcgcaaatctctcttgcagagactgattggctgattgactgatttagagacagggtttcactctgtagcccaaggctgccgtgcaagtggcgcaatcacgagtcttattgcagcctcaacctccccagcttaagtgatcctcccacttcagtcttccaagtagctgggactataggtgtactggcagagtattatttaaaatgcaaacaataaagctgggttttgtgtctgaaacagcgaaggacaaccagctactgtcttaatttcttgctgaaaagaaaggacagacacttttacttttccactgttttattacaaaaatcaaatttcatttgttacaattcagcttatttattgtaataatcaaaaaaggggtttatacaaggtatttttatacagtttataattaaagcacttattttacaaaaggagggaagtgaataagtggacaagggctgaccaaatgttggccattataacataaatacatccttgcaaagcaccatcgtaccaaagtcaatgaacaagaaacaccagttgactttaagacaatgacgaagattaaagcttaagggaaaaaaataaaagataaacatctgaaagcagcaccagatccttcacttgcaaataaggctagtccagtttaatcttcttggtatcctctctactttttaacatttttccttactaatccatatatttaatttcatgtcatattggatttaatcagactttaaaaattttccctttaatacccatatttaggcattagatatatagaatatgtatctatatataaatatatctctatcgcccatcctgcttatatttgactgaaaaacacaaccaccaaaatggacagttcagcaaaagcgcgttgtctgtaattctctggtgttgcttctgggcaaaccctaagtgatggtggagaatctaacagttcgttaggtctgtactctgcttctaaatacaagacatcatttagtttgtaattctatctgtaaagtcatggagatttttttcagcaataaactcaacaatttgagaatgctttatgaaaaagaaaaacagcaaagtttacctcaattgaaagagggtgagggtagagtcagtaactgattaacctaagactccaccttccactccactcaggtacaggctttatgagacgtagatcaagtcagacaatagcctgagagtgtgaattcacaatacttataatttaaattttaaaaaaattataaacgtataattttatacttgaggtccaaagtcttctaccataaaatgttgagaatttcaaaagctaaattttgaaactattataaaatggtgccatcccaaaagtcagaagccacacatgcactacaagtactttctaaaatcatctttcactacaagtactttctaaaatcatctttctcttggttcattttaggcttaagaaataccaaataaaattaaattccttgggtttaagaattctgataatgttttaaacaacacctgactataagcttctttaggactcagtccacacttagtgcatagtctcatctgtagatgcccaaatatttgtccacctactgataactggtcaacacactcatatccatactctaaatcaactatggatgccatatgtagacttaagcaccacacatttattaagagctgacatatttcggatgtgaaaagtccaagatttttgtttctgaatcttgttagatacgtaatgataaccaatatgtaattcctatggcatgcaaatgaatgaagtgggacaaagcttcccctacaagaaataaaacaattcaaaatatgacatttctaagaatctaatctaggcagctgcagcctgtttactgcatagaagtaggcgtgcttaacgcatacctcttcagtctctattatgactactggtatcaagtcacataaataaacacacttcattaacacactaggtaagctacagctattaactctactggaagtattcttcattaatagggctttatagcaaaagaaaaagatgatcctccaaaactgctacctaatacagatgatggctatttttaataccttcaataatgaatgagtttccttcatataaattactgactttaggatatttttaaatgataaagaaatacaaccctcaaaatcatcttaaaattgtactgctcaaagccccttcccccaattactggcctatattagattaaaatgtactttaaagtcttcatttctaagtacctatcatctctgtagaataggtgttctcaaacttactaaagaatcagagatctcttggtaatgtatcacaagctacttttatattaaaattaaagtaactacataatcttctgctaaacagatatcttgtgatatgctgtaagagtggcagaaagtgccaaaggcataataaaatttcatggaagaaaaattaatagtcagaaaattctatccaccaactctctttgtttccctgtgaatgtgctattatctgacttaagcaaacaaaactccttaagtcactattcagaagaccacgactctgttggagcaaagtccaggccttagttataaaagaccacttcaatgcagaatagcttactgtggtgcacacaaagtatgttatgctcaagtttatttcttggacaattttaatcacatcagttagtgcatatattttaggacacatgttcaaaataaatacttttgcatataaggaatctaatgaaacattattcattttcccccttggacaatgaatttaatacaccaaatttaaaaatcccttttcttttttccccctaatttgtgatctcatgcttttcctctcaacttttccaattacagcttgtgtttgataatcaatatacagtttacttaagcttaactgtccatgtaacctaaggctcaataaatctttccaaatttgacaattctctcattaaaaagtactcccagaaatattaagaatccatctcatctaccccagaaagagaacactgagattaggctgaactgccttcaaataattttaaacaaattggcacacaaattagtattttgaagaagaggccattgccatcgcagtgcaagcacgtggactgagatccaacaaggcaatattcttcttagttaattagagtgcaagtctccacatgggaagcccaccagatcaagatgcacatttaaatatgtaaacatatagaattctcaaattctaactgacacccaggtattgctaacctttccatcttcatttaagcatcaagtgccctgtgtatcacagaatccaagttcaatgtccattttgtctgacactgtgggcacttagttccagcaatgggaagagttcatgcttgtctgttttaggattctgatagatttaccatttgcttatatgcaaaatcaagtgcacctgattcttacagtctccaacaatcagcattattctgaaaccacaattttatcttcaaaaactttacttaggtatttttaacttgcatgaacagttacttcacccttgcccaaattctgaatcctttcttccactgttttctcttgggccctgaaacccagagaggccttggcaagacagaattaaaaaagaaaaaaaaaaaattcaataattaactgaccaacacctcttaagctaaaaatacattagtttaaaaccattcaattttagcagagaagtgctacacatgtgtaaaaagcaggaaacgaacttctggcaaggtggcagagcaagtgctagaatcattccacaggtcagccctgatagctcaagatgtagcagccccagtaccatacatgacagcaggtcaggcagatcacaaaagaggcttccattattcccttccacccaaattctgacagctgagaagttaacagtttgccttctcatttaatcctcattgttaaatttgttaaactatcttaatccataatgggtaagagaggacccacataaaaatattgggtgattacaagaataatttgtggataatttgaaaacagcctaacattcacagtgggtaacagaaagatattaaattcatgtcacacattagaagaggtatgtatgtagacattattctgagaaaaaccggtctaaagaacatgaaaacatcacaaactgttaatatagggaaaatcctaataagaaaaaaatctttttaaatagattgtctctaaccagaacatatttaaatgttttactcagaaaacaaacaaacaaacaaaatatatatatatatatatatatatatatatatatatatatatatatatatataaatgatttcgtactgtgatatatgctgaaagtagtgcaaggatatgagatttacaacaaaaacataatggttaaatttttaattcttaaacattgtctatatgtgttgtaaaaagacattttaatgagcattaaaacaatcttggaagaagagaaataatatgtctaacttttgatcattatgcaaaaacagcagtcaaattgaagagctaagcctactggggaatggagctagaagaaatattaaaatcaagtttaatttagaaaattccatttagtcaatgcttcagcttaaaaaaatcatggtatcttagcaaaatgacttaccaagttgctggaggaggcagcaaggtaaacatacctagagaaaaaaattcattttgacagaggtatggattctaaaggtagggacagagacttgcacacacacacagcttcatggcatcttaccagagggctgatctctcctacaacagcaacacccagaatgggtttttagaaatatctactttcctcactagcactgttggattcctagagaaaacaaagcccttcgtccaaggttagtattaattgcatttttttcctttcatcatttcttacttgttggccctcaaatgttagttaactgaaggctatctggctacatccatgtatctatggtttgctgctctgagatggacttaatttttcttcttcctcttttttatttttggtatcaataaagcccagatattcctggtcagtgatgcctttattattcctgtttcctttgtactcagttgcttcactgggtttaaggcatgctttgtgtatttagtttgcaaaaataaaacttttagtacaaattttttttatacaaacttttatggcacaagcagcaaatctgctgttttaagaaaatatataaatatccttttcttctgtacaaatatctccagtattccctaccccattttataattttaactgtacatggtctgcctcatccttctctaatagctccctccccccctccagatctcaaccaaatttatatttacatttttacgttggaggcagtcagaggaggagggcccctcctcaggaggagtctgtacagggagagggtggcggtgggtagaggtgatgagaatagctcctctctgtgtatggagaaggtgggcagctttcatagttctcctctgctgacaagtattggcttcggggtgtgggaggtgggggcacaggttctgaatcatagttcaagtcactggtatagcccttggctgttgccactgaggtcattctccgactaggagcatagtcactgtcacaaacatctgtgctgcagggtgtggtggggggtgcaaagtgccggtagctatatggcctgtagctggtatagggagaaaataaagagaagcagttagttttacaaaaaaaaatgatttcccctctcagaatagaggtattagatgtcaactaccctatgaaaacaataagctactgcaatttaaatttacacagaccaagaggcaattttcaatggcagattcgctgaggaaaatagcaggtactttcttatttgcaaataagaaagtggcaagtgaaaatgaacaggatgggaatgcagaggtgaattcaatctagcctctggttgtgctcttacatcttcaagttaaactgtatcacagaataaaaaatgactattcaaatttgttctgcagtttcatagcccatgggaagaatgggtttttacatattttacactactcaaacatgtcagcattccctcaacattctttactccaaaattaacctgatgaataattaatttaatgacatctgaagtcttcatttctttcttctgtacaattctgtacaatttctgtacagtccaggctggattttggtagacagcctcaggggcataactattccattgttgttatcttagcaaagggaaattgctgtgattgggggaaacggttttcattccctgtgtataggtaagtacctctcataagagcagctttaaacatcaaaatgataaaatttaaatgcccataaagggtcagtgaattttctaatgtatatttcagaggcctagtttatttcttacacttgtttatctttacaagtgacatacagttgttaggtttgtagcactgctaactaaagaaaaaggcattggaaagagagaaacatactagtgaaaataagatctgacctaagttctggcttttctgtcattcctacttctatttttaacttcttatacctgtttattctaaatatggtaaagctgatcttaaatttatcccaaagattttttcataagctttctcatcaaagtgactacaagagaaggggaaaaccaagttaaaaactgatacaacgattcataaaacacctagtgatacagagcaccaccaggtaatatatcccaggaacccaggatacaaaccatttgatatcacttggcttgcttcaaaagaaatggctgccagattgttcacagtcacagatcaaattccttgttctactctgtctccccttcttactactgcatttgattagtctttaaaaaagaaagaaagaaagaaaccagcctgggcaccatagcaagaccccgtctctacaaaaaataaaaaaaagctagccaggcgtggtgacacacacctgtagtcccagctacttgggtggctgaagcaggaggactgcttgagcccgggaggtggagactgcagtaagctgtgattgtgcccctgcactccagcctgggtgacagagcaagaccctgtctcaaaaaaaataaaaataaaaataaaaagggtgcaaggctgccagagaccaaaagttatatgacccactgagtgagttctcaaaggcttttactatcaatactgacatgatgtcacagtttgttttgtttaactctttgtccaatcaggtgtcaatccttggtgaaatttctaaggtcaacatttaaaagtccaaatacttctattttcatgaaaaaaaaaaaagaaaacaaactgaattaataaaattttttcatgtcccagtttaaaccaaaatctcaacaaatgatgtaagttttgactcagaggaaacagaaattgggcttatacggaaaatagttaagcaagaatagttttttatgcaatcgtgtttattctgatgagtgccttagtcaatttgaattaaggacattacttttaaaaaataaaattttgtatctttctcctttctcaattttcaggcttctgctttttctgttttggcttcctagaagaagaaacttgtggcagggaaagcaacattacaacatatcattaaaacaatcagttcacagccaaggctatttcagtcttatctaagctgaaatgagaattctgagtgagatactttaagtggtttccacttcatttctacacatgggtgaggtcgtatcaggccaatttgactgaaatgctaggaaagataatagaagattatctagagaggatagaagatagaaaagattatctagaagataacaggcacttgagggatgcccatgaaccctgggcacttcagtgtgtagatagaaactctcaagctactgatggtctgttggcctttcaaggaacatagaagtggaagctgacacaacagtacttgacctgctcaacacactttatagactcataaattagcaaaaaggaataattttctcttttttggcttacaaatacactttatttatttcaatctttctttattccatgcaactacatgagaaatctttcactccaaattgtaatagcatatgcaagcaatggctgaacttacatttctctcaacttttctaaaattctgtgctctgagtatgttgctgttttaaactctcaattctatgaaccaatcttatcccaatatttcattcttagaatatcaaactattttgaaaccagtcactttggtgggtaattcctccttagaatactgccaaagcctgaggctgtattttattattataaaagccagcatttgtgactctcttaaaaaaaaaaaaaagtataggccaggtgtggtggctcacacctgtaatcccagcactttgggaggccaaggcaggcggatcacctgagatcaggagttcgagaccagcctggccaacatggtgaaaccacgtttctactaaaaatacaaaattagctgggcgtggtagcgcaggtctgtaatcccagctatttgagaggctgaggcaggagaatcgcttgaacctgggaggcggaggttgcagtgagctgagatcatgccattacactccagcctgggcaacaagagcgaaatccatctcaaaaaattaaaaaaaaagtataacgtcctgaaaggaaaggatttgtggtagaggcaatgtcagtactatcaagataagatgactagtctctctctggtgaccatcgtctactcatttggggctatatcaggtccacaactgaaacactttcaataaatactgcaccttattttagagaaggatgtgtattacctgtatgacctatgagtggaaggactgtttgaagaatatccaaattccatagtgtaatgtgatcgctctgtggctggggatggtggagggttcaaaatctaaaagaaaaaaataattaaaatattaaaataacaacatagaaactatcagactttctttcaacttttcttccttcatctctattagtgtttctttacaatacactattagcacaattcttcttttccaaagaattgacctcaaacagtactttgggactatggcttcctcattccctaagacctcatcatggctaaaaagtgcaaagtgacaaaaacgaaaatctgtaacctaaaaatcattggtcagtacatttaggtcctggttatttaaaatagtaagtatttagagaaaaattattgatttaggagaaattccaggtgtgcttcctcttttgggaagtcataaaatgaaggccctaatccctcaataggtaccattcagtagttctacttttacttgaaatgtgaaattaatgcccagtgctttcaagtattctggttactacacagtaacttaaaagatttataagcatggatggtggtgtgtggtaagtcctttgagccttttatgcctaaattttacattcaaaaactacttttacattactatcactgatcacccacatttaaatgagttaaaaaatctaagatcttatgtatgtcgcattcaaaggaaaacagactacttactgcagggaagtaagtgcctttggtgcttgaagaactacttgatgatgctcctgtaacatgggctcggtcataggggggtccactgcttccccccatgatactgagggagctgatcattgatttacctcgagacattcctaaaataaaaggaggttaaaaactgaagatgagtatgatatataaaaatgtatcaagcaatttcattcaacagtaggattacaaatatcaacagtgaagtagtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggtagaggttgtgaggcagggcatattaaataccagacttgctcaaaagaaaacaaaaaaacatttttagggcacaaacaacatatgaaagaatattttttcatctaatgaatataaatgttgctagaatcaaaactaccagtgctaaagaaaaaattctattttttccaagaagcttcccaaattccactaactgaaaataggtatggcaacaaagcaacactaccattaacagtttaaaaaccatgtttgtctacttaagagttacacccatagtaagttcctattttcagagggtttttgcaaggcaccgccttctccatattcattaaaaggaaggcgtcttttaactaagggcaccagaaaacattaaaaagaaggccagttccctagagcaacacggcctacccaagcttaaaacttctggctactcagctatgcctaaactagccctttgtcccttattagcacatgaagtcaggagaaaacttaagacatattctcccttctatcatccagctatttacaaatctttgttggctgaagggaatcttatataatttttggcctccttttattcatgggctccatagtactagagttccctggtggtgaacttaacctgtggtttacaactctttcactaaatgactggctgattcaccttccgtagcatgcatccagaattgcagtcagagaggcttagagcttgcatatgtatttgctttatatgctttgacaatttctaccaaaccatatctaaggccttctgtgtaaagagaaggtgctaatagtaaaaaagaacgtttgtccttataattgtttaaactcagagtaatatggtttcagacagactctaggtagtattcttttccacaatggaaactggcagtcttgcaggaccaaagacttgattctcaatggatccatcctgactcacctggaagagatcctgacaaagaacttgggtgtggcacataaccaagaggcacagaagctggtccatgaactacatagtcattagtcatagtttccccatctcccttcatacgtggacacaacatcctctggcagataaagtatacagttccagacacaaaaatggtgacaattacgccaataacagaaccaactgtattggtggcctgtggtgctggttcttcagtcggatctacaatgaagaatgcagtatggttatttaatagaaaaacaactgtatattcaaaatagtaatcaaaagagggcttgctaataggatgtgaagctataagcctaatgaagataattcataaacacttttcttttttatgagtacatacataccacgccctgaagacatatgaaataaatgtcatcattaggaatcaaaatgaactacccttaaatgaagacagaaataaaacaataggttggaaagtgtaattgtaaacagatagaaacaaagatggtaaatgaagtacagatttaaacaccattaagaagctttaaataaataaacagataaaatccattctacttcattctatataccatacaaatgaacaacggtattccaagatttcgggaaaaaatttatgaccagaagggataaacctagaaaagtcatcaaatgttttacctggaatggtgaagaagccaaaatcagctctgagcacatgttagattttagatttgaatagtgacatttaggcctgatgaatgaaaactggaagctaaagataagcctcagctctcaaatcccctatgctgctggccttcaggctgtctagttgcctgagaccaaggaacataaggtctttaatacctgattactggaggactcacaaagaaaggccacattgccagaagaggacaccaccccagggattcaccttccctggatccctgagctacccgtttaagaagcagagggcatcaatatcagaggtagagggaaagtgagcttattgaaattagagcattactgtctctattcagagggaaaattcttccattctgaacagttaaattttatctcacagttgcagatcctttaaaaaacttcctcctgcttcatcttacctcaaatctcccatccatatagctaaactcatcctctgacagattatatgaaagaaatgcgtgaaaatgacatctctaagttacataatatgtagggattatcatttacaaatttagtctgtggaatctgaagcatagactcttcttagtccttgagaacaaccgtctcatcttttcattcctttttagtcccctaacattcctttgcaatgccaagcttcaggaaagaaaagtttacattcactaccctcaatccctagcctctgggtcacaccataaactccctgaaatcagacttccaccctcaccactgcactgaaacttttctgtcaacagtcaaagttctactatttgccatattcaatatattcatttcactaacctctttacacaatactgctggctcctgtcttctctttaaaaaaaagtctgatcaatattcttccaagataccactctcttaattttactatttctgattattctttctctgcttcctttgttggcttcattctcttctgcctgcatcttaagtgcaggtgcttcccagagagatttctatctatcacctactattttcctcctcttcttactgtcctgggagattctatctactgtcacagctttcattattatcaataaactaatgagcaccaaatctctcttctgagccacagttccttataatcaacttcctgaagagcttcagtgggatattccatgagtacctctcaggcaacatatcacaaactgaactcactgtcaccatgatcagtcatttctcctagattccaggggtaaagacaccataaataaagtcatctagtataagataataaaaagtgatggggcttgtggcaaagtacacgcctgcctaaaggcatttaatgtaaattaaacatcacatcaatcaaacattacatctgcagccaagatgtggtatggtactttggttttcagttcctgctatatatcccatttaatgactccagtcactcagtgaggtacctgtgggtcaacttaaacttatcaactatagctaagtggttaccaattcctctttattctacttctgaaacaactccgaaatctgttctctccctgccacccccactcctcctcctcatgatttagatctttatcatcttctgcctaaactctaatcgcttcctttttaaattacaggctgcaagtcattcgtaaatggtgagaatgatttagtgggttacaaccagctttgaaaaaataaaacagaaaatgtcagaaagtgttctatataacatgggtaaatatttaagtgttgtgtgacacctttttaaatgcatgagctcacatctctgtattcctcttgatgcgatcagaagtttgaaagcaatcaatctaacagatttccctgcctataagcttatcacctccaacccactggctttacaacttctgtattgcttgaccatgctagtctttttcttgaaattttcagtgactctccactccccattgttaatattgtctaggctctttagaagaaaagcatagtcctccatgattgtacctttacctatgttatctcttgctgacacccctcaacagagcctgtattttggcagtcccattacatggagtttcccagaggtgcctgtttcactcttttctgcttttgaacagtatattccctctgcccaaaatgaaatttctccaattatctacatgatgaacactattcattgatcaacacccagtcttttttttctttttttttgagatggagtctcgccctgtcgcccaggttggagtacaatggcacgatctcggctcactgcaacctccacctcccgggttcaaacgattctcttgcctcagcctcctgagtagctgggattacaggtgcccgccaccacgcccagctaatttttgtatttttagtagagacggggtttcacatgttggccaggctggtctcgaactcctgacctcgtgatctgcccacattggcctcccaaagtgctgggattacaggtgtgagccagcgcactggcacaacacccaatcttaaataccatttttctaagatgccttccttgatcaagtccatctttgtccctaataagctgactactctctcatttctactgccacctgtgtagatttctattacagcacttatactccataatcaatgtatctactatgaaccaggctatgtgttttttaggctaaatgatatatatgttaaatcatttaattttcttataggcatcaggttaagcatcattctcttcattttgaagatgaagacctgtaattccagcactttgtgaggccaaagtgggtggattgcttaagttctgaattgaattcagaccaattgaattcttttctttttttttttttttgagacggagtcttgctctgtcgcctaggctagagtgcaatggtgtgatctcggctcaatgcaacctccgcctcctgggttcaaatgattgtcctgcttcagcctcccagtagctgggattacaggcatgcaccaccacgcctggctaatttttgtatttttagtacagctagggtttcaccatgttggccaggctggtctcgaactcctgacctcaagtgatccgcccaccttggcctcccaaagtgctgggattacaggtgtgagccaccacgcccggctgatttctatgtatctaaatgatttgagaattttgtaactttggttatagtaaaataatatttactcttttctagtgctttactaaatgtttctgtgaagatttctgtgcataagaaaactgctatgtttaaagaattactgaaagcaaaacataaaaaaaccttcacacaaataattagcttaatattaatacttattacttagaaaggaaatctcgataagtaaacctcacacataagaaaaaaaattgtttaaattctctgttaagagtaatttatagatctcagtcctacttacaacaatccagttcatctgacttgtcactgcaatccacattatgatcacacttcttgtgctttccaatgcactgaccattggcacagcggaactgatcaattaaacaaagcactggaaaaaaaacataaatagtttccttatttttaatatcatgtaaagtcaaactctggcaagaatcaaaaggtgccttctgaacacaaatgaaaaacaaattagacttttagctataacttaaatattattctctggagttccattggttgagagagagaaaaaagagtaggagaaaaaaatccagcaggaaatttcctaacattttttttttttttttttttttttttttgagacggagtcttgctctgtcgcccaggctggagtgcagtggcgcgatattggctcactgcaagctctgcttcccaggttcacgccattctcctgcctcagcctcccaagtagctgggactacaggcgtctgccaccaggcccggctaatttttttgtatttttagtagagatggggtttcaccgtgttagccaggatggtctctatctcctgacctcgtgatccgcccgcctcggcctcccaaagtgctgggattacaggcgtgagccaccacgcccggcttattctttacattaaattccctctttcactaaagaattctagagaacttggctgggttgtttttaccatgggaaaagttagtaagggaaagtgaagaatataaaatatgttagagcgtaattaataaatccactaattcagagctcattggaaacagggactatttttatatactgaaggcctaatatattttagtttcatttctcaattttcaaagcttattaatttgtataaatcttatgcatatggagtgaattaaaacaataatatggaacatggcactatgatcagaagtgatacagtcatatgtacttgaaaaaccccaactgacactaagccaagtaatactgaagtttaaacaactgaatgggaaaaaaggattgcatgctgaggcactgaagaattctggataccttcacagttcttctcatctgatttgtcctggcagtttgcatctccattgcatcggagggcaccatcaatacactgcccactggcacactggaactgggactctgagcatacaggacaattgagttcatcactgtggtcttcacattcagtaaacccatcgcaccgccaagccacagggatacagtcaatttcccccgtgaaacaagtaaactgctgaggagaacatgttggaggttcttcaaatgaacaaggagaaggggagtgacaaaaacacaatcatggtcacacagaagtacaaacacatacctgagtgaagctcatttaataattaacatacacaaaatactttataataaatatgatttataactatctcatctattcaaagaagaaataaaggttttcacattacttcctttacattcactataaacttttgcccgcaaaactataaggcaaaagttttttcatatcttgtaatccaaaacaggattgtaatatttgcaatccgttacagtctcacacaaaacctaggaataatcagtataattaccaaagactttaaagttagcctagcactcaaaagttttctagctctaagcttctcaaaggatagtccatgaacccttaggcgttcctgagacctctttcaggggacccactaggtaaaaactatttttataataacattaagatgtcattgcttttttttggctatctttgcactgatgctgcaaaagaaatagtgaataaaacttggtaccttagcagactcaggcaaatgacaacaaactttattagtaatcactgtactatacacagccacatgtgcacagtttaaacaaacacacaaaaagaccaatttcacttaagaatgttattgatgaatcaataaaaaattatattaaaatcaacccaagtgtatgcctctttaatagtctgatcaatcaaatggcaattatgcataaagctcatgttgcaaacctaagtgtggtagtttctaatgggaaagcatttgttttgagttgtaaatccaactcaaaatggaatgtcatttttacttgaaagaatgactgacaggtaaattatacagtagttatttacacttgtctgttagtgaattatctagagaacccataaccttatgatgtgaccataggtcagaaaaccctgtaactttacaacagagaatattgcagattacaggtgaacattttacatggggaattttagggattatttaataagagcctattatgtattcagcactatactatctatattgtatggagaattaaagtagataaaatatatccacgtccttaaagcagtttgaatttggttggggatagaaagaaactaataaacataaaacaaaggacactactttgaactgcatgtcatgcaaaccgtgtgatatagtttggatatttgtccctccaaatctcatgttgaaatgtaatccccaatgttggaagtgaggcctggtgggaagtgtttggatcatggggggtagatccctcatgccttggtgctatcctcctgatagtaaatgaattcttgggagagctggttgtttaaaagtgtgtggcactccctctagcctactctctctctcttgctccctcttttgccatgtgacctgcctgctcactcttcacccccgccatcaaagtttcctgaggcctatccagaagctgaacaatacagccggcagaaccatgagccaattaaactttttctttataagttacccagcctcaggtatttctttatagcaatgcaagaatggcctaatacacagttgtatacatctgtcaaaactcgttttaatacatacattaaaaataattgctaaatgtgcaagcaagaaaaaaggccctttaaaagatattttcaaactggaagatgagatccttgactcagttttatccatgttatcattaacataaagagaaatttttctaggatttgcctcaaagtaacactccagcaccctgatagggaaacacatgctattttttgggggggggggggggggagggtaaagtaaccataaaattgaccaatttaaccactttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatcccacccacccgatcaacaatttttatatgttgaatacatattctctttcaatatttgtttacagaaatatatattttatgtacttgtcattttggcaacatttttacatcaacttcatgattataacatttaatagctgtataaactcagttattttacttaataattttcacaccattagaaattcatttaaaaatttctgccactgtagataatagtatgatgtagtctttttccttcagttgaattaacttagaattatccccaaaaggaggatatctgaattaagggtatgaatactattgtggtgcctgataccatcatactataatttaacaatggaatgtatctatttgttaaacctgctaagtgattaaaccaattttactacaacagtatcactatactcagtgatatcttttaaaaaatcattttttactagataaagaagcaacaggaatttgctgatggatttgaacaaaagaatattctttccatcagacacattcccaacaatgacacataaacttagagaatctacaatttagtggagagagattacaggaggtagaattaattcatttttttaccttttgggagaggggggaggctactttaatattaggaagcatactcattcacaggctgaaaagtgtggtaatatatacgcagtgaaatactattcagtcaaaaaaagtaggaaatcctgtcatttgcaacaacacagatgaacctggaagtcatcctgttaagtgaaataagctaggcatagaaacacaaatactacatgatctcacacgtggagtgtaaaaaagtcaaagaaacagagtaaaatgatgattatgaggctgggcagggtggcagagaagaataacagaaaagcctagtacaatacaaatgaatggaacacacgcaaccaattaagttagtagacagagcaacttcaatgcctagtcatagaagtctaggcttaagatatggaatatgtttgcatttagggttgcacaagaaaattacaacatatttacctccacatgatagctcatcttgaagtagaaccaggtgcatggggcaagaacaccttgtagtaccatccccctttacaagacaaatatgtgaacagccaccattatcctgagcacaagggtgctgtcctgcaaagagaagaggtgaggatggggagaggagggggagtggagggggagagaagtgggagagaagagaaaaagggacaaccctgtcaaaactatttatgaaaatcaaatgtataatcagcttggactctttttttttacttttattattattattatggactttttttacttttatcattattattattattattattattattattttgagacagagtcttgctctgtagctcaggctggagtacagtggtgtgatcttggctcactgcaaactctgcttcccaggttcaagtgcttctcctgcctcagcctcccgagtagctgggattgcaggtgactgccgccatgcctggccaatttttccgtttttagtaaagatggaattttaccatggtggtcaggttggtccagcttggacttttatttccacacaatatgattcttcactcaatctctacacaacctacaagaaactacttctatctaaccactgtccttatatatttatatataaaatattttaagataatggtaaagctcatcttaatttttgtgaatatgaagaaatgtttactgaaactaaaaaattgctagggagaggccgggtgcggtggctcacgcctgtaatcctagcactttgggaggctgcggcaggtggattgcctgaactcaggagttcaagaccagcctgggcaacacagtgaaatcccgtctctactaaaatacaaaagaaattagctgggtgtggtggcatgcacctgtaatcccagctactcgggaggctgaggcataagaattgcttgaacctgggaggcggaggttacagtgagccaagatagtgccactgcactccagcctgggcggcagagcaagactccatctctacaaaaaacaacaacaaaaaattgctagggagaatgctgaaacttgagtattattctatttaaaatataagaattctcctatattaagatttttaactcagaaaatccgtatatctgaaagacaacttcagtcaaaaagtgtatcttaatgaggaatccattgagaattaaagagttattagaagaaaaaaacttaaaaggcacatgtaacagaacaattcagaaacaaaattatttggtcaactgcaaaaggtaacttgtaatactataaatgtctaacttcctcatacatgggctaagtaaagaaaccactaggcaacttttcaaagtctgtttcacaagttgtatttttaaagaatcattgtttggaattttctgtttagcctgtattaaaagcaacttgacatctgtcgtcacaaaatatgaacatctaatataagccaccatttattatttgactctcttccacaataacattggttctgcttcagtttgtgttgagactgagggagtcagctatctacaaatgagcatactgtccaaaacagacatcacacattatatagaatatacagtctatgtagcagtgtttctcaacctttaattccatgacatttttgataaaaatcccattctctttaatattagaaatttgaaaaaatgatttacctaatatacaatcatatttaaatagttattaaataaaacctctcccttgaaattctgaaaatcttgagattttctgtaataaaatattcatgtatcgactaaataaataacttaggtatgatatcattatcatatttctattaaatgttcagcctgagctacaagtcataccataaaatgacaacaatttttaactttctaattctcaattacttgtaactttacttctaaattcatgaactgtaccaacataatgaacacttgtacagggctactcctgtttcttcattctcctttcatgcttaaattcaatttaaaagcactgagctgagaagttacagaatttcaataattgtctctctcatactcaatttaacattggcatccccggtaccatcatgtatgatcaacagtagtgactgctaggaaggcactttttaaaaaacgttttgcatatataaactcatttattcctctctatgattagggtaattttgatgacagatatgaattaagaactaggccaagatgactagccattttcaaaaaaaaataagaaaatatttctggctacttttcttttttcctggggctcatggagatggctatttttctaagctgggaattgaaatatttatcccaaagggggggaaaaaaaccaagcacctactaattaaacagagtcttctctatgtttacacactaatttttagtttgttttgcctaagaataagattaacccattataactatattcatcattatataatttttactttttttcaagctatggggggaagtatagagagggaagaaaagaaatagatgctttatgttatcagtattcccaaaggaactgaaggagagaaaaacaaggcatgataagcagtcattgttgtaccaggaaatattcttttttaacaggcaagacccatgcctttcccccatttctggtttatgagattatgtttaatttggaaaagctcccgggtaaggttgacataaggctttaaaagcatgaagaggctgggtgtggtggatcacacctgtaatcccagcactttgggaggccaaggtgggcagatcacttcaagtcagaagttcgagatcagcctggacaacatggtgaaaccctgcttctactaaaaattaaaaaaaaaaaaaattagcgaggcatggtggcatgcacctgtaatcccagctactctggaggctgaggcatgagaatcacttgaacccgggaggcagaggctgcagtgagccaagatcgtgacactgcactccagcctgggcgacagagtgagactccgtctccaaaaaaaaaaaagcatggagagttcaaaaaaatggcaaaactaaaagtgcatgaaagtcttcaaggaaacagagtttaaaaatccacaaaagtacatattaatttattataacacatgattcctccaattagctttatcccattaacacttactgtattcttgaaggttcagctcctttactgcatgaatgtcactaagctgggcaattcgagcttggactttggttctaccctctcgacctgtcatgtcaattttttcaatcatttgctgctgtttatcaatccaatagagccagttttcaaacacagtaagtcccacaggctgcaagatattggagtcttctaatactatccggttagcaccttggaaaaggagaaaattcaacagaaatgactcatgtgggtcaagttatacttttggtaattatttactgactaccagttagattctacaggtagagaaaagaaaaaaaaaacaagatctctaccacaaaacttaaaaatcatggtaagacatacactagaaaacagccaataaactagatattaatatgcaatcaagagcaagtaagtgcccaatgtgcagtaaatattctagttcatagaaatgtagaaaagaacttagaacagtagtttgaaaaaccctaacttatatatacaacagataaaaatggcacttctctggaggagcagtggtggtggacccagagttctgagtatacctgaggcatttatgaagaacagcttcactctcaccccacctggcttctcagaacacaattagaaaaaatgactgactcaccccaaggtaagaattatttctaatcatctcagacatagagtcatccagactctgaggaggcaacttctgctattgttgcacagtgagaaagttcttttatacagtgggctaaaatctgtgttcataccccccaccctgctttattcagtttctccctcactcaaaaagaaaaaatatactcattccttctttttcataacagtccttcaaatatttatagaaagttcacggttcctaagtcatgagttcagtcaaacaaagacattagctgatattttggaagtatcaaggaaagtttcaggaaagaggcaagcaaaatgccaactttttaataaatgaagaaaagtggggagatattccagatgggaaggcattgcctgagtcaacattcagatggtaggctaagcacaagtttacttatatattctctcctaaaactctactaatatggtgattgaaaaaattttaggccgggtgcagtggcacacacctgtaatctcagtaatctgggaggctgaggcaggaggatcacgtgagcctaggagttcgacatcagcctgggcaacatggcaaaatgccatctctacaaaaaatataaaaattagccaggcatggtggcatgcgcctgtagtccaggtactcaggaggctgagatgggagaattccttgagccagggaggtcaaggctgtagtgagccaagttcacactgcactgcagcctgggtgacagagtgagaccctgtctcaggaaaaaaaaaagaaagaaagaaaaagaaaataattttgaaggtataaacccataaggacaaagaaggcagaagaacagaagagagcaggaaagtgatataaattttggaagctggagaatagatagaccagggataatgacacagtagcccagagaaagctaaaggcctacagccagtgaagctaacaatgaaattaattagctcagaaagtggaagcaccaggtattttagaatggaacaaaggtaggagttatgtggctggggctgaaagaggagtactaattgaaaatatgtgtaagaaattacacagcaatgttctcagtatttttaagcctcatactaaatacaaacagctaaggatcaccaaatatttaaagaaaacctctatctttaaatttgaagcccaagacaaacacaacaaaggaacttggagaaaaagacacaaaagcagaagaaaacaaataaataccaattaaaaaaaaaacaaaaaacctaaagaataggctgtcttcagaggggcagagcatttggagaacaaaaaagagcccttggaaattaaaaacatgatatccaaaaatttcaaagaaaaatgcaacaagagggttgggagacaaatttgagaagctctcctcagaaagtataacaaaaacacaaagagatggataataggtgagaaaaatacagctacagtcaagaaggttcagcataaaaataaaaagctccaaaataggaaaatgaaaaataaattatcaaagaaacaacacaagaaaacattccagaatttaaggtgtagacttctagacagaaaggatcaacctagtaaccagttcaatgagaaggaagggaaggggaagggaaagcacgagcatagattttaaaaatcttttttttttttttttgagacggagttttgctctttcgcccaggctagagtgcagtggctcaatctcgcctcactgcaaccttcaccttccggtttcacgtgattctcctgcctcagactcctgagtagctgggattactcgcacccgtcaccatgccaggctaatttttgtatttttagtagatatggggtttcaccatggtggccaggctggccttgaactcctgacctcatgatctgcccgcctcagcctccaaaagtgctgggattacaggcgtgagccactgcacctggccaattaaaaaaataaatcttaaaacaaaacattagcatatcaaatccagcaataaataaaaagaatgtaccatgctaaattttatttattccagcaaactgagaaaagaagttaaattccttaatttgacaaaggttatctacagaaaaaccttagcaaagaatacttaatcacaaagtattgaatgcttcccccaagctcaaggggaaaaggactagaaaggaagaagaagggaaagaaggggaaggagaaggggaaaagaagggaatgatgagaaaggggaagaggaaagggctgggggagggagagtggagagaaagaaaaaaggaaagaagggaggaatcaaacaaaggcacagtatcaaattctaggacattgaggggaaagaacatgttaaaagcttctggaggaaaaaggaaaaggacagcatacaaagactgaaatcacagtcacatcaaacttcccaatgacacaagatgctcaaagacaatggagttctattttcgaaattctgagagaaaacagctataaaacatgaaagcaaattatcaaccaagtgtgaggaggaaaaaaaattcaaacaagatcaagaattttaaccttttatgatgagcccctttcaagaagctgctagaaaatggtctctcttaagaaaaccagaagaaatggagtccaggaaatagcaggttcagcatctgtatactcccaggacaatggagaaatgaagttagcctagaaaccaagcaaatccagactgcagcaagatgatgaagaaacccagagatgtgattttaattatgaagacaaatagatggactgcttgatgcatatccatttattgaaacaatatttacattacacaagtattaactctgcagggaggaaaaaagttttagaaagaaatgtacctaacagtaatatgttcatagccataaataataagtaattaagtctagacttaaaaaaattatggcactagtcacaggtgggtcctttctatctgcaaacttgtgcctcgaattctggaaagttcataactatgctggggaggatggaaagaaaattcacacgtgtattttggcgacatatggtttaagatagcaaaatctttatcttccaaaggaagtcaatgtttaacgtctaaaagagaaaaatcaagaaatagcatttttaagcaagtttattttaaaataagtgaaaatagttgtgaatgcttctaagcatgggaactgagagcagcagagtagagcagtaggcttgttttttgttacaagccaggtagaacagtttgatatccataatatttacatgtattactttaatgaaaattaaaattaaacaataaagaagaatgatttttaaagattagctggcggtaatgaaaggatggtctgaggtagacaactgggtaaaaaaggaagtcaatagtgtcactgcaggcccccagatatggtaaggacctgatctactttgatgctggtgaaaaataagtaagctactggaaccaacaaggaaaagatatgcttatttattcaacaaactaagcatgcactggatgcaattcgctataaaaggctatgtgggtggctacaaatacgaaatagaaaaaggtcccaggatgaaagcataattatctgtgaatacgtaagaaaaaaaaaatcaacttgacagtaacctttttcagagaatagaaaaagaacaaacatttctttttatgtggccaacaaagccttgatggcaaaacaccaacaaatacctgacaagaaaagaaaattataaggtaatccttctcatgagcgtagattaaaaaaaatctcaaaacattagcaaatcaaatccagcaataaaaaaaagaataatatatcatgctagattttatttatcccagtaaactggggaaagtaagtaaattccttaatttgacaaaggttatctacagaaaaaccttagcaaagaatacttaatcacaaaagtactgaatgcttctccaagacctagaaaacaacaacaacaaaaaaggattctattatcatcctattcaacactgtactgggggaccccagccagtataaggaaagaaaaaaacacaactctcattatttgaagaaacatgattctataacataaaaaatcctaaagataagtatacttagcatggtcctgtggtacaagctaatatgctagaaggagaaaaaaagaaattgtatttccatattccaggcacaattagaaaataaaacattaagtttagaatagtctttaccactagcgtttaaaagcaccaaataagaaggaataacaactctaatgaaagataggcaagacctctatgctgaaaattataaaacattaagagaaattaaagatctaaataaacagggagatttaccatgatcatggtttagaagattaatattataaagataataattctctctaaactatcaatttaatgcaaacccaatgaacatcttagtatgtgattttttttggaaggggaaactcacaagctgattctacaatgtacatggaaattgcggtagttaacaatagccaaggtaatcctgaaaaaatactgaagacacagatgaatctattgcagttataataattgacagtataatataagtaaaggcaaagtgaccaagggaacatcagagtctagaaacaaacacacacaaatacagtcacctcatttatgaccaaggtgatactacagagtagtagggaaaggacagtctttccagtaaatgatgctgaatccaacagtaatgtggaaaaaaatgcattttaacccctgcctcacactacacaccaaaatcaattccagatggattacagatcccaataagaaaagttaaatgaagaaatttcagggaaaaaactaaagtatctttttgtacctttgcagaagacaaacatttctttcttttttcttattgctatacatttatgtggtacaagtttttttaacatggatatatactatgtatctatgatgtgtacaagtgtgaagtgtgagcttttagtgtaaaaccatagtgtacgttgtacgcattaagtaatttctcatccctcaactcccatgaagatttcttaaacaacataaaagatgttaaccgtaaaaagaaaattaataaactgtactacattaaaattaggacctttcttttcatctaaagatactactgggagaataaaaaaggtaaatcacaaactgggagatttatgcagtatatatcttgacaaaggattcatatctagaatgtacaaagaattcctatacaacaataaactttcaagttaccagttttgggttattttttgagacagggtctcggctttattggccaggctggagtgcagtggtgcaatcatgatcatggctcattgcagcagtgggacaaaattaattgtaatgaatgaaacattttcatgaagagctttatcacagacctgcctgccaggcatggtggctcatgcctgtaatcccagaactttgggaggccaaggcagggggatcacttgagcccaggagtttgagactagcctcagcaacacagcaagacccccatctctacaaaaataaaattagccgggtgtggtggtgtgtgcccatagtcctagctactcaggaagctgaggcaggaggactgtttgagctagggagtttgaggctgcagcaagctataatcacaccactgtactctagcctgggtgacagggcaaaaccctttctcaaacaaaaataaaaacaaaagatagtttaaaatattgacataagtaactaatgtacaaatgagaggtgatatccatggaatactatgcaaccataaaaaaggataagttcatgtcctttgcagagacatggatgaagctggaaaccatcattctcagcaaactatcacaaggacagaaaaccaaacaccacatgttctcactcacaggtgggaattaaacaatgagatcacttggacacagggtggggaacatcacacactggggcctgtcggggggtggggggctaggggagggatagcattaggagaaatacctaatgtaaattactagttaatgggtgcagcaaaccaacagggcacatgtatacctatgtatcaaacctgcacattgtgcacatgtatcctaaaacttataattaaaaaaaaaactgcaattacttttgcaccaacctaatacattcagattgcaacagaaggtgaattttggaaaaaacaattattcaaaagacataaatgcattaggtacccagaaaaaaaaattagaggtgatataagagacagaggagatcagatgagggaaagaatatactataccaggcgtgtaactatacatgcgtaagtgtgtgcctaactgtctggaatcagagaatacataatggaagggaggcatttgaacctgaagacattaaaaaaaatgtgaaaaaaagattaaaataattataaatgtattcaaacatacaaaaatgtacatgatacaggagtaagcagtctcaacattttagtatgctaatgctccagacttgagatatatttgcttatttcttgaggaaaatactgacatgtatgtctgtttcttttcccctctcctctctcccctccctccctccctccctcccccttctctctttccctctctctctttgttgaagaacctgagatctgaagatctgagatctgagatcccacatttcttttttctttttctttttttttttttttttttttgagacagtctcgttctcgttccataacccaggctggagtgcagtggcgccgtcttgactcactgcaaccaccgcctcccatgttcaagcgattctcctgcctcagcctgccgagtagctgagattacaggtgcccaccaccatgcttggctattttctgtatttttagtagagacagcattttgccatgttggccaggctggtctcaaactcctgacctcaggtgatccaccctcttcggcctctcaaagtgctgagattacaagcatgagccaccacacctggcctgagttcccacatttcttaacggtatatatacatacactgtgtatacacagtgtatatactatacggtttcaaattttaaacaaaactagatcttaagaatttttctgaaatttaatttttaaaaatcattcatgttagtgcacacagatctaccttattcttttgaatgactgtaatattccatacactgatagaatgtatttctccatgaaggactatcacaaataatgctcagcaaatacccttatacacttacatcggtctttctctaagacagctatctacaaaggaaatcaccagatcaaagggaatgcatattttaaattttgattattactggcaaattgtcctctaaaaaggctctatcaatttccacttccaccaaagcacatgagggcatgtaattttctaccatactggccaatgctaggcaataatcaacgttaacatatttttgccatgctgacagacacaaatagtatattttaatttcatttacctgatcactagggaggccaacacagactatatggacatcagaaattggggacagaggaggtaattataattacagacataagattgcagagaaatgtgaaagtaaaagtatatcttaagacgaacaaataatttaatttggttaaaataccagaaaggtaaacgccacgatgaggttgtgaaaggtgaatactaacttataccaacttaagagtacaactagacttttttcctacaggttatgaaactaccctgaagattttttaagtaaagcagtgacattaaaaccatgcttcagaaaatttaggagccatgtgtaaactttcatggagaaaaactggcagggagatcaaccagaggctaggatttggccacagatgacaagaacataaactagagcagaagagttaggaaaggatgcattagaaatgtattatttacgccgggcgcggtggcttacgcctgtaatcccagcactttgggaggccgaggcgggtggatcacaaggtcaggagatcgagaccatcctggctaacacggtgaaaccctgtctctactaaaaatagaaaaaattagctgggcgcagtggcaggtgcctgtagtcccagatactcaggaggctgaggcaggagaatggcgtgaacccgggaactgcattccagcctgggcgataaagcaagactccgtctcaaaaaaaaagaaatatattatttacagaaccaagatcaagaaaactggcaggtagttaagtaacagaggagtaatcatgttgacagttgaagaaaaagctcttcaccaaccaacctgatgctgactacatttaatgaataaaactgccaagaaatgtgccaaaaacaatacgatgcaagaaaaacacaatagatgaatcatcttaaaaactcaaattaaaataaggaaacatatttcttgggtacctgagagatcactgctttcaattcgccggagatctgaatcagcccaaaagagcttgcccagcctgctatcaagggctaaagcaattggtttacttaagccactgaaaaagaggacctcccgttctgtcccatccaaagcagcccgttcaattttaggagacctttcctgaagattggtaaaatacatatacctagagggaaaggaggaaaaaaataagttactggagtaagaaaccacataaaatgaggatattcttattaagacaaatggaggtagagtatttttaagtattgtttttaaaagttttaaaatacgtattttttgaccaggcacagtggctcatgcctgtaatctcagcactttgggagactgaggcgggggtattgcttaagcttatgagtgagagaccagcttgggcaacacagcaaaaccccatttctacaaaaaataccccaaaaattagccaggcatggtggcgtgtgcctgtagtcccagctacttggaaggctgaggtgggaggatcacttgagcccaggaggcagaggttgcagtgagctgagattgtgtcactgcactctagcctgggtgatcgagccaaaccttgtatccaaatatatatatatatatcctcttttatataaatatatatgtgtatatatatataaatcctcttttatataaataaatgtgtatagataaaaatccttttataaatatatacatatctatttatatatttacatttttaaaaggtcatgggacacttttactacttttaatagtagcaacaaaggtacacagaagttattagggagctttcatagattaacagaatagtgttagacataggcacacatatgttttcagaataatacgacaaattaaagatcagtgactagagagaccttaacacaaaattttaaattctttctaattaatctatttaataactaaaaagaagttacatataaatcacttcttatatttaacgtctagatttcatccttttcctctcttttgaagtaagctactttacttgctgaataccttatcattgactcagatacaactgattattgagtatttattaaatgcaaagctctttattaaatgaaagaaagcatactagttctcatcataaagaaaactgatgtctagtggtaaatacaagactaaaaaataattaaaagtaacgtaaattggaaaggactaagtataacttagagaggcacagatacagagtactgagtattcaggagggggcaaaaatcacatctggctgggatgaggtagatcgaggaaaacttcctggaggacgtggcagttgaaatggtcctggaggtgtggttaagacttagaattaaagcactagtggcccaggaaagaaagtctgggcagtgaaatcagagaaagtgtaagacaactgttaagataatgcagaaacaaactgatagagaatattgaattgtttgctggagcacaggacacttaaaggtaaataaataacaggctgaaaaagaagggtgaggagagtctcagaagccacagtatctgaacgccactttagtaacataccctttctctgggtttaccacaacggctcgaggtctgtcctgctcgcctttcagcaccactccaactgatctcccatctaatcttgtcacattaatgacattggtagcctcacaagtccagtagatgtagcggctgtaaatatcaatgctgaggtcatagggttgtatttccaggttctgactcggaactgagctcacaaccacagtaaagccctagggaaaaaaagaaatacagagaaaattaaactccaggggcagataaccctgaggcaatcagtcacaatgcttacacctacatgggcacacagctgagaaggctctctcaagtcttaaggagtatttcttactgatacctttttttatgggtaatgtgcttctttgttaatacacatctcaaatgttccttgggttatcctgctgctgaaaaaaagagctgaggtcagattagttgctccaagaacctgataatgccttgattaagagatgggagtgagaaggtggcaactatcttctctaaactggagacaactgtggctaaaaccacaccctagaaatatctctaaagcagcggattgcaactagaggcaatattgccccgccatgggcatttggcaatgtatgaagacattttttactgtcacgactgtgggaatacaactggtaactagcaggcagagaccagggatgctgttaaacatcctacaatattccgagcagccccccacaacaaacaattaatccagcccaaaacgaccacagtgcttgagaaaccctgctctagagataacagcaactagtaaaggctacaaatcaagtcatctccttttctgatcctcaagtctacacatgcaatttttttacaataaagtcaagcaaaaagagaggctttgtccatttgtgccatctgaactgtatcttactggtatctctgaagtaacatattccttaatttctatctattagttatcagcccatcagtcctggcctatatggtggaaagtgtgtctggaatacacagctattactataccctaaatgatctctcagcagccctaaatatattacctccttggtctttattttaagatgagacatagtgaaaaacggtactctaacttccctaaattttaatacattcaagatacaacttacgatcactgctatgaggatgacaacaagtaattatttatagtattataatcccagtctgacagggctcggccacagaaagcaagcaaagaagtatcgatagtgatgtgtaaatccataattggcatgtaaatgggtaagatttattgataatatcctcattcccatcccacagtcaccatataattatgaccaaaaaaacccactggattaataacatgttagatgtttttaaccctactgagattgtgttatatgtttcatatcctctgaaccttttaaataatagttaattagtaatgtaaccgttatttattgagttcctgttacataacacataagagctatgtgctttgcattcttttcagctaaaaaagttcctaagaatcctaagtgagggatagagctggaatcagaaccaaggcctatttcaaggcttctaatactccatacaatagaaatgtaaggaaaaagacttcataaagaaacgtagggggcagtcacaaagccattaccaacacaacagcttaagtacgcctaacaattttcatcataatatcatcatcaaacaattgcttactcaaaatatcgtcagaaggaaaaaataagctaccaggtccagaatttcagtttcatacacacatacacacacacttaagcagagtcaagacttaagtgaaacagagtggttggtgagtccagttattagtcaggagaaatgaattttgaaccaagctctcaattacctggctgccatcttcttgtgcctttcggatcatgttttgtcgtgagtcaatccaatagagttgcttgtccagtgggtcatagtcaatggcccggacattccgaaggctgtggatgggaaggatgatgtcggggctctgttgttcatcaatcaccatgcggttgatggcactcttttgactgaagagcaggaaagtcgtaggagcttaaaaggaagaaaagagaaaatctgaaatctagttaccctacatcctctatcatccaatgatttgatcagcctgttgtatgtatttcatacaaaacagacatagatgttgaagagctaaggctgaggacaaaattctttggcatgccctcaaaaactctcttcagagtaacactaatcagctctctggttaccaaatcagttatgaatttacctaatgacatagccacctaccctgtttttctccatcttgtccacagagataccacagaaaacttcatttccatcaggtatttgatatacaaaattctcctggtctaccaagtgaataacccttaacctattctgtctggtgggtggcaggaagcctgggcttttataaattaaagcagaaacttctagactgattttacacttgacagggcaagacccatctaaggaaaaaaaaaaaaaaaagaaggctgatttttagtctcagccttctcatttgatcttaagtcactgagcctctctaggccaaagtttactcagcggtaaaataaaagtcatagtcatcttgtccctctcactgagttgctacaagaattttacaacgtatatgaaaatactttagaaactgtaaggcactatataaatgtaaatttttaatgtttttaataacttaaaaattatttataaaaaattaatagagatggggtctcgccatgttgcccaagctggtctcgaactcctgggctcaagcaatcctcccaccttggcctcccaaactgctgggaatacaggcagagccactgtgcccacccataaatttaaaataattatttattaccagtagtggcagtaataaacttggtattaacaggcactgaaaccttaatggattgcagatactattttgttgtttatgtgaggacggcatggaaagagagcaggtaaaaattacaaaaataataatagatgctttatgatatggtttggctgtgtccccacccaaatctcaatttgaattgtactcccacaattctcatgtgttgtgggagggacccaggggcgggtaattgaatcatgggggccggtcttccccgtgctgttcccataatagtgaataagtctcatgagatctgaaggggttcccacttttgcttctttctcatttgtctcttgccaccgccaggaaagaagtcccttttgcctcccaccacaattctgaggcctccccagccatgtggaactgtaaattaaacctctttttgttcccagtttccaatatgtctttatcaaccgcatgaaaatgaactaatgcagtggtgcgatctcggctcactgcagcctccacctcccaggttcaagcgattctcctgcctcagcctcccaagtagctgggattacaggtgcccaccaccatgcccagctaatttttttaattttagtagagacagggtttcaccatgctggtcaggctggtctcgaactcctgacctcgtgatccacccacctcagcctcccaaagtgctgggtttgcagatgtgagccaccatgcctggccaagaatgacttctgggagactaccaacaacttcaaagtctaaggccattttttaaatcttcattaaaatatctgtatacatttcataattatactctattttcttagtgcttagacatcacctaaatacaggagaattttgtccttctcaggaatataaaacataaatagccaagccacgactccttgctttatttcctcctattccccattcttcacagctccattatttgtggtctctcagcttattttacatttacactcaaatgaatactggcttaaatcccaaaggaaatcagtactcacaaagaaacttgttatctacaaaactgcaattctgctttaagttcttcattagttaaaaacccacactcagcttggaagatttagaaagttatcccaatgatcctactacaaatctccatttctggagtccatcatactaatacattgatttaacaacttttagcaatttttgtggagtccatacttcgagtagtaaaaacacatcacacagaatagctaaaaagtctcccactatcatttttattttaaaagaattatattttggcagtactactttcttagtaaagcaagaaaaaaatttttaaaggttctaaattggctgggcacagtggttcatgcctgtaatactagccctttgggaggctgaggcagtaggatcacttgaggctgggagttcaagaccagcctgaacaacccagcaagacccccttctgtttaaaagacttagaagaaagatcccagagttttagttcccatattttcttgcctgggaagcaattaatcaaatatatatttggctcctaggatattttgctgggtactctcttttccaagcaaaattttaaccttcaataagattccacaattagttgtggatcttgttgttctagaaatgcagattaagagaaagccatatgtggctccaaataaatacctgctccaaaaagtctactcaaatatattaaaaattacaaattaactggttatttctaaaaggcagctaatattttgacctattttcaagtcagtgtttaaaatgacaaagaatatgccattttaaaagcctaaatccaccctatcaaatttattaaactctaaccacctctctcacatttccttcagaatggtgctttaacaacgacctcatctggttgtcttgagtctcgcattcccacaatggagacatcagagaagctggaggatgagatgtacgtaggagggagcttttcagttctcttctgaaggcatatgtgttcactggtagcttagacaaaggtgttgctcttgtttaagaatagaataaactataaggccaagaccatcatgtatgactgtaccatttgtgctctgtgccaggggcattgagtaggaactgaaatccagtccacacttccttagccacgccatacacctgtagggctaaatctgctcagaggaaacatctttttccaatttgcacaaagatgccacagaggccacttcagtactgaataaaggattacacaatctggcttcccatttcctctctgatctaatttctttattcacttcattccagcaacactagcttcctaggtgttcctctaacatgtcggacatgttcccccaagaccttttgcatttactatccccttttgcttgataggccttctcccagtatccgcatagctcatttcctcacttccttcagttcttgacataaatgtcattttttcagtaagaacttccctaatcaccccagttaacactgcagtccctgtcaccatcaccctttcttgctctttatatttcttcattatacttattgccacctaacccctgacataatttatttagtttattatctgttccactgaatttcattcactgctatgttttccaacggctgaagtaatgcgcagcatgtaataggtgcttgataaataaacactcattacaataatatatgaagaaacaaagaaacaagcaatagagcctagcgcagtggcatgtgctcgtagttccagcaactcggaagattgaggtgggaggactgcttgagcccaggagttcaagtctaacctgggcaacacagtaagacctgatctcttaaaaagagggaaaaaagccagaaagaagcactgagtgacaaggagagccttgtagctatgattttgaaagtaagaaaataaaatttgagacgaggaaaggaaaagaaaaatttatttaggacctccaatatattacatatcatactaaatgttatttaatccacaaaattatctctattttataggcgagtgcgctgaggatctgaaaggttaggccaggcgtagtggctcatgcctgtaatcccagcatcttgggaggccaaggctggtggatcacctgaggtcaggagttcaagaccagcctggccaacatggtgaaatcccgtctccactaaaaacacaaaaattagccaggcaccgtgatgcacgcctgtaaactcagctactcaggaggctaagacaggagaatcacttgaacctgggaggcggatgttgcagtgagccaagatcacgccactttactccagcctgggtgacagtgtgagactctgtctcaaacaaacaaacaaacaaacaaaaagtctttcagccagaactgccatcttccagtaatttgccaaaatgatgaacacaaagggaaagaggagaggcacccgatacgtgttctctaggccttttagaaagcatggagttgttcctttggccacctatatgcaaatctgtaagaaaggtgatattgtagacatcaagggaatgggtactgttcaaaaggaatgccccacaagtgttaccactgcaaaactggaagggtctacaatgttacccagcatgctgttggcattgttgtaaacaaaaaagttaagggcaagattcttgccaacagaattaatatgcatattcagcacgttaagcacgctaagagccgagatagcttcctaaaggaagctatcagaaaatggaaagttatcagaaaaagaaggaaaatgatcagaaaaagaaagaagccaaagagaaaggtacctgggttcaactgaagcgccagcctgctccacccagagaagcatattttgtgagaaccagtgggaaggagcctgagctgctggaacctattccctatgaattcatggcataataggtgttaaaaaaataaaagacttctggactgttaaaaaaaaaaaaaaggttaaataattttcccaaggtcacaaagctgttgggtaaaacagcgtatgtgtttttccaagccttgccttgtttcttcattcatttatttaacaataatttcttgagtatctaccacagactaagtgttattctaaggcacataagatatgtcaatgaagaaaacagaaaaaaaattgttgcttcatggagtttatattccaacagacaataagcaacaaatataataaagaaggaagtgacataaatagtagagtatataaattacataatacataaagaggtgaaagtgctatgggaaaaagaaaagaaaaagtacagataaggggcactggcacgttggatagaatggcagcataattttaattttaaatagcatagaccaggtgtcactatgaaggaaacaattaagcaaagacttggacgtgaagggtatccacgcaaatatatgcaataacactccaagcagagtaaacaagcagttcaacagtcatgaagcgggagtacccggcctagctgaaaccagcaacgaggccagtgtggctgtaatgaagaaagcaagagagacaagagtaaaagctgaggttagagaagaaaactgagtggtggggagtgagagtgaagaaggggttatgaaatgtggggtataggtcatgtaggacccagtaggccattataagaactaggtttttattctgtgtgaaatgagaagccaaacttctcaaaagagatgtctatatatgtcactatcgtttccttttttccattcacgttttaatgtactgcattctgcatttcaccattacttccctgaaattactctcttcagggttaataaccactttacccaaaaatccagtgtatgctattttagacctccccttactcattcaacagagttcatttttgaaacaacctaatctctgtcttcgtgcctctattctctcccgcttttcctcttacctctctggttgctacttctcagtgttctctgtgaacttctcttcctcaaccagagttgcatagtttaccaagtgccttcttttctctccatcagagttagcccactgatgggggttatggcccacaagttaaatctggcctgctgcctgtttctgtaataaagttttactggaattcagccacttccatttttaaaatgtattgcctgaggctgctctcacactgccatggcgagagctgggcagagttcagcaggtgtgagacagcctaaacacccacaaagcctatgagagaaagctgctggctcttgaactataccttctctttaggtaacctcattcattttaaatacatcctggtaatcccaaaatttgtatcttcaacctcatgtctcttctccgatgatagtccatcatctatgacacataatctagaggtcatccttgcttcctccctttctttcccacacagaactcattaacaacttctgcttgctctagcttccacatacatctcgaatccatcaacctctcttcaacacacacgctgctgccaccaccattgtccaggtctacctgcattaccacactggtctaactgacttccctgctactggttctccccagaaatcagaccatgtattatctttaatcttcataacaaccctatacagcaattactattattattccaattttacaaatgagaaaaaataaaggcttaaagaatttattacttgtgtaaagcaaaaaagctaatgtgtggcagagattccaaagtataacctcttaatcattccactacatgcttgtgtcctttctctttcacaactgaagttggcatcagaacagaccaaatttttcctatgggaattctgacacattctctcaagcacaaaagaaagtcatgtcaatagttaattacctctaatatccttagcagtttgttactttccatcatattgacccaaaccctacacccctcccataatctactctttctgatttaatctacttatttcttaatcgtatctaccaatttgttcttgtctatccaccaagaaatgggccttcatatatatttaagttataagccaggtttcccctagccaacaatgttttgttacacactttgttgttagtgttatgtgtgtacttgccggtatttaaaaatcaggagatgagggagtcacacacacaaaaaaatctagattcaggaccaaatgaaaagatctggtaacatcagcttcagttaaactgcaactgcctactatgttcattgcatgttctctttagtttctcatcaactgttactttatactgggttacatgttctcatacgcgttttctgtatggcctgttaaacatttaaattttttatgactgtcctactctttgcacttcaaaggacaagtaagttgtgttttgcgattcactgttttactgtttgtaatgttcttcccttcctttacaataaatatgatgcatgaaactatgcaacttttacacttaatatttaatgtccaagggtaaaagacttaatttttcctttttttttgaagaaagaatctctctgtgtcacccaggctggaatgcagtggtgccaccatagctcactgcagcctcaatctcctggggccaagtgatcatcctacttcaccctcctgagtaggtgggactacaaatgcacaccattactctggctaatttttttattttttgtagaggcaaggtctcgctatattgcctaggctggtcttgaactcctgagctgaagcattcctcccacctcagcttcccaaagtgctgggttacggacataagacaatggaccagcataagacttaatttttctataacatcaaattgctatcatcaaacaagtaataagtaacaaacacttgcattcccctaccctttaaccaaacaaataaccccctctggatttccacactatttaactttagaaaaaacacacactaaagtactttgaaaatgctgctttctctcattctagcttgctttggagggaaatgcagcttaccactacaagtcctgttgtcagcattaagagagtagtgggcagggcatccacaaacaaaacccccaactggcacagccaagcagaggtgggagcagtgcccattgctggaagcacattcattccaccctgactgtcgagatgagtgaaagacgaggatgtccatcacataatccaaatggccctgaatgatggtgcggttttggccactggttttgttggcacgctcaatgctgcgtcggctccagtccgtccagtagatataatcttggtactgagttaagccaaaaggatgaggcaagtcatctgctataacttcacggttgagccctattttcagaaaggcagtagacaggggagaagcagagtgatgaaatatgtgagaatacaagtgtcttgctggcaaaaagaaaaaaaaaagccctaacatataaaacattacattgtaagcaatttaaaatagaaaaattcatttaaaagcaattctaaaacgagaccaattctctgaaatcaatctatcttctgaccccatgcttcaaacttatattcctgctacaaatcactcagtttcctaaaattcttgcaaatggtctactttaaatgtggttttattttctctatataagggtctacagttcactttttcttcttgaactatagaaggaaaagatggaaatatatatattttactggtacaaaagtcatttcaggagtatctagggagttataaatttcattacaagtccaataataatgaaactttcacataataaaaagatgaatccaagtacctggatcactattaataacaaacaggatacaattccagaacagaagaagaatggacacattcatatgaagttgtattaaaagtatctaaccaatgataaatagcagccactgatatttgcatggaaagaatatactgtttgagtaaaaagtagtaaagcttaccaagcatatttgaagattctattaagttggtgtccaggtctgtccaataaagcctccttttagcataatcaatagttaggccgtttgcccgccccacatttggaactaaggtagtacgttcacttccatccattgcagctctgtctatcttaggttttccaccccattcagtccaatacataaatctaaattcaaaataataaatatttaacatttcaattttttattatctgggggaaagagtcatattcatgcaaagtaactaaataaatttaaagaaaacatacagcaaatcaaggaaatgggttaaacaaaatcacggctacaatgctttcaattattttggcaccctaaactaaatatttttttccatatcccaaaaaggaagtgagtcagctttccttagtctttccaatacatttgttccatccaaacctaggaattggaaataaaccaacagtttattgcagtactggcatttgtaaaattaacattcaagaaaacagcaaaggtttaaagctctggtctcagaatctggttcacttctgagtaaaatatttttatatacttttgaatattaactaatttgagtttttaatatgctgaacttactttttgacttgtgtaatcaactcttcctcaaaataagttgcagaagtacatgaaaggtaattataaatactaagcctttaactgaagtcaaaagcaaagcttgaaaatgtatttggtcatatggtccaagggagcatactatatggtaagaacaacgactcaccccttgatgtgtccactgggcaatgaacactacactacgctacaacaatctctgtgaaattttagaataattactttgctgttattttccatttttgagttttgcactttaatcttacagtaatcctacagtataggctttttatagatgaagagcccaaaacactacaagaaatgtgaacaacttatctaatgtcttcaagccagttagatgacagagctagaactagaacctaatccttggccaaatgccctttcaagtaaactagtgaggtgctagtttttgagactcttgaatactggaactaaaaaagcacatcacatgccagctctcacgaaatacctgaggacatatattcactcatcagcctgtcagctgatagctgacttggtagcaatgtatgaacatgcttttctgaaaactgaaggtgtcctgcctttatatgcatttgcacttgtcatttgacaggcatgtgcacaccacaagagccaaagagaaacaactgtgagagaaatttcatacttgccagcagcaaccaattagtcccaactattaaatttatctgtctggcagctaatgtttagagcaaagatcaccacaatatgtcagtgctgactagatgaattactagctaatcatggaatcaatgtcacttcagggaaattattttaagtagcaaatacagtaaacatatttatatgttcacactgtttacttctttttttttttccaagatggagtcttgctctgttgcccagggtggagtgcagtggcacgatctcggctcactgcaacctccacctcccagattcaaacaattttcctgctttagcctccagagtagctgggactacagacacatgccaccatgcctggctaatttttttttatctttagtagttacggggtttcaccatgttggccaggctggtctcgaactcctgaccttgtgatctgcccacgcctcggcctcccaaagttgctgggattacaagcgtgagccaccacgcccggcctgttgacttcttttataagtggaatttttctttagatttcagatttcttagctgccggctttaaaaaatttgctgactcttgtaaaaaggaacactcgcccttgaaaaacatcatgttgtgaacagtttattctatcttgtaataacaaagctactgccagtttataataatgatcaaaccaaactatccattttgaattaataaatactccaaaataaagctttttaaatgtagttttttcttagctcacaacattgtttcggtgggtttacttcaataggcttggaatctagtataactgggaaggagtgcaagcaactacagatggataatacctcttggtatatatacttaacatatcagtatactcatcagtaacatttattaacccattcccctctttcttcacctaaagttaattacgacaagagtaaaattagctaataattattcattcaaatcagcaaaatatcaatagtgtttttaaaagttcatctatcatttagttctcagattcctaatacgtattatttaaaacattaagaatatcatctgtaactatgccatgttccccgaaatgtacactgcagttgcaaagaatgcacatgtaaagctgtttacccttcggcagggtccaacgcgagagctctgggactatctaggtctttccacaccaaaacttgtcggtgctgcccatccaactttgacacctcaattcgattcgttcctgtgtctgcccagtacaagttcttcccaagccagtctactgccatgccttctggataatctaagccgaattctaccacatgttccagtgcactgccattcataaaggctctgctgatggtctgcaaaagaacattaacaactaagtcatatggcataagtctaaaccctatccagaaagaaggtttggtttggtttttgtcaggggcaagaggatccagaagtgccaagaggcatactatttcctattaaaattcacataacttgcaagcacagaaaaatttgatgtcaatctctaataaatgcaacttcaagttttactgccaattcaggggagaaattttaaaactctaatgcaccaaaaatttattctactaacagcagaatgactttacttttaaaatttatcagtaatcaagtggaaaagctgtgaccacaatgctacagatcttaattagtggtcaattttctaaaggtgcttaagattatggcaagtcatcatgcctaccatataaatgaatgtaaccattatactaccattatagcactgagtcccataacacttttaaaaatcataattcaaactaataatagatacatcttatcaagtattatcctaagtacgttttgtccgtagattttgtcacttaatacaacagtcctgcaagtatggcatcacccctattttatgtttttgagacagagtctcactctgtcacccaggctggagtgcagtggcatgatctcggctcactgcaacttctgcctcccaggttcaagtgattctcgtgcctcagtttcccgagtagctgggattacaggtatgcgccaccatgaccagctaatttttgtatttttagtagagacggggttttgtcatgttggccaggctgttctcaaactcgtgacctcaggtgatccatgtgcctcagcctcccaaagtgctgggatttacaggcctgagtcaccgcacccagccaccccccattttcaagatgaggaaatttagaacatcacccaatgcaaaccaaaatttatttatttcatttattcacttaataaatttaactgaacaccattagaatccaactctgactccaacaccccatgttttcgcatattacaaaaaagtttacatgagttatctgaaacaagcccaaaacaatctggaagaagaaaagattattcttcagatttataggttgggagcttcctctctggctatcctggtattcttttcagtaactattctaggaagaagaaaataaagaataactcattgttggccttttccgcctcagtcaggccctaaaattttgtttaaagtaaatcacgaatttttttttaaagtaaatcaacagccattttacgtgaagcacacatttccttactcagctaattgcagaaaatgtcattcatcattttcaaatggaagaaagtagaggaagactatggcttgcagatttaaaacactctggcaaagtatctgtattaaaaagcatctaataaaatactgaatgggcctttcccttcacttaaaaacttaagggttttggctgggcgcggtggctcacgcctgtaatcccagcactttgggaggacgaagcgggcggatcacgaggtcaagagttcgagcggcctggccaacatggtgaaaccccgtcactactaaaaatacaaaaattagctgggcgtcgtggcacgcacctgtagtcctagctgctcgggaggctgaagcaggagaatcgcttgaacctgggaggcaggggttgcagtgagccgagactgcaccactgcactccagcctgggtgacagagcaagacaccgtttaaaaaaaaaaaaaaaaacttgagggtttttgttgaactctgcctgtcaaacaatgagggaggtgggtcacagcatgaagattcagaaattctagaagttctcccttttagtccctagctttaatattccaattcttttgctaaccttgagtgatatatcagtccaataaattcggttgtctgtcacatcaaaatccaaagcagaagcttctttgacaccagtgagtggaatagccacattattattgtttgtttccagagaaattcgtctgatatctgctctccgtgaaaacaaaaggaaagcctctgggacaatgcaggtcttcatgtcactgatgagttcaaagccaatagggcaagcacagcgaaggccctgaggtctatagaggcagagatggctacatcccccgttttcctcagcacaggggttggaacctaaaagattaattataaaaggggcacagaaggacacacacattgatacattcaacatattttcacttttaaattacttaagcgtttggttcacaaatgcctatgattatgtcttgctcccaatctcaagtttcaattctaatatcacaaacaagtaatatgcagattaatagggagtaaaagcatggtgaagtattttcctttaataccacagtaagctttaaagtaaggtatattattcatactatcagactgaattcttttgatgaaggtgtgcctgtgcatgtgtattcagcccttcaattcaaactgggtagctagagtagtaagtcaacgtttaaaaggtcccttctcagtaaaaaaaaaaaaaaaaaaaaaaaaaaaaaaaaaaaaggcgggggggcagtaaagaaggtttcaaaattgcctcaaaacatcaataatttacactgctgactatctccatcttttttcattcctggttcccatttctaagaaagctttggagttactcaccaatcactcgatgaacatttgtagcctttaggcccatgaggtcaggcagctgatctatgatcacttccctctctgcacttcgtttatgaactctttcaatgctacgcctctgccagtcagtccagtaaacatagtcacccaacaaagtaaatccaaatatgtgaggaattttgtcttccactagtactcgtctcccagtgccatcagtattcataaccttcaggtttaaattcaaaagagaaggggatgaattatgcatttattcttcagctaaaaataacaaatccaactgcctgttgtataaaaatccaagagtcatcttggtattcctattacaatgctttctcaaaattacatgatgattttataaaaatgatttcaaattttccatataagcctctatttgaccacttttccccccaatctcatattactcttccttctaaaaattctggcaactttagattatgcaactcttctattaaacaattgtggcaaaattaaaaatacagtatcatcaccttaagtttgcacatttgttttcaaattataatgtaccttcatatacattattttatcatatattttgttttataacatcttttattttatcttgagagctttgcctatggaaactgagattcatgtaaggtcacagagcttgtaaacacagttgatgtctttttcaggactttttccacttagcatgctttttattttgttgttgttgtcagtaacaacaaaaaacagataaaagggatctcaataaatctctcattcctctgagattataatcacaaaagtatcgggattatatgacaccctctctgcatctaagtttcaagaaactaggatgtaccttctctttccaactacctaatagtaacattattaaattcactctggcattcatactgtattcacagtgcattcaccatgcactattcagtgttgacttacttgggatacctttattgacataatataactaatatttgatatttacatataagattatatctgataccttttttgggggggtaggagcagatattgttcacatgtacatgtttttagtatgaaataacatttctaaaggctaatttgcccagcacgcaggcccctttaagtgacagaaatggtctcaggtagggacttgaacactgggactctggaaggcttgctgcatctttcagaacagaacaaggtcttctcagtttctactgcagcatttccaattgcatttccaggaacatgtactgctacctcatctaaaaggtcatatacttaacagtgaacctatgtcctgcattagggagagttcaatcattctattagggagcacccaacacagagtgataaatattctgtattatacaatacaaaaatattactttcttataagtttgtggtatgttaaaatatgcctgattcggttttattcttagatttaattctatcttattttgcattatcttacatttaataaattacgctaattttgctgatctttacattcaaatgttggctttcctattaaaatttgctggtgtaaaagcataaactagatgcccaatattaaacttttaaagaataacacttatatttctacttctattatgagatcaacaaaatcttttctctttcagctatatcactttccaacatttttgtttattttgataaataaatagcttaaacaaaagatggatgattaagtatgaattaggaaaatgaggctgggtatggtggctcatgcctataatcccagcactttggaaggccaaggcaggaggagcacttaagccttgggtttcaagaccagcctggacaaaatggcaaggccctgtctctacaaaaataccaaaaaattagtcaagcatggtgtggtaagcctgtagtcctagctactagggaggctaaagcaggcagattgcttgagcccaggagtttgaggctgcagtgagctataatcaagccactgtactccagcctaagtaactccagcctaggaaaaaaatctttaaaaagacagaaaataggtaagaatgaaattaaaaatcattgtgagaaaaataataaatgccacaattctaagacctttttagtaaacataattctgcatcttctatttaccagtttcccttcattcttctgttctctaaaaaatttctcatgatcagcaaacagtattgtggcagaaagagatttgtatttcaaatataagctttatcactcagtgggtacctttaagcaagtctcacaaataaaatagggacagcagtccaggcgcggtggctcacgcctgtaatcccagcattttgggaggccgagacgggtgggtcacgaggtcaagagatggagacaatcctggccaacatggtgaaaccccgtctctactaaaaatacaaaaaatttgctgggcgtggtggcgcacacctgtagtcccagctactcgggaggctgaggcaggagaatcgcttgaacccaggaggcagaggttgcagtgtgccgagatcgcgccactgcactccaacctggcaacaaagtgagactctgtctcaaaaaaaaaaaaagggacagcgccactgccatcactgaattagttaaggatcaaataaaataatgctaaatatatagcacagtattaggtgcactatctggtaaacactggttcctgtcctttaaaaatcattttattaaaatgctttagttcctaaatgtaaacagctaaatgattgtatttaattatttaatgtagtgcttcaaaataaaaatacataaatataaaagaatatatgaaaataaaagaccaaaacaaccactcactgttaaactgaagacaaaaaccaagagacctttatgtatcctgaaaccagtgggaaactacacagctacagcctcccatttcctactcccatttttattgtttacttttgctagttagatataaagtaactaaaacagtaaacaaaaaagaacaaatatttgacaatttcatatgagtacacttttgctgctctgccagacccctaactcacctccccgcaaatcaaacaacattagtaaagacatctagtaaatgcaaaccaccatgatagacctgatgaatgctgagaagtttagaacagggcctcttccagctaatgtattacaatctaattggggaggtaaacgatatttacattaaaattacacacatatcccctctctgtaagtaatcaggaaaaacttcaggaaataatagcagttgaaattcatcttgaagaattagaattttgacaaagaaaaagagaaacagattttctagaaaaaaagaaatgagttaagacacagcaaagccaaggatgcacacgacatgtttgactttgaaagaaatgccttgactgagatagaacgaacacatgggggactcaaaggatacagcatcaagcagataccaccctatggcaggtattaaattccaggataaggagaattacagaaagcaagaaggttctgaaagcactttaagcagggtgacacaataaacccatgtttcagaaacacttcatttatctctgtcaccctgttcagcttgtgttaaagataaatatcttattttaaatgtagaattatgaaaaaaataaataaaccaatatagaattatggttagcaaaatattttcaatttctgtgagatggcaagagaggtccaaaatcccttatctaaagtcagggtcagttgtattcctgaattcagactgtttttgtctttttgtttttttttaaagaaaggttaacacaatgcacatagcatatcacctctacttgggttcagggcagcactatttatagccaaacatgttaatatttctgcaataaaacacggccaggcgcagtggttcacacctgtaatcccagcactttgggaggccaaggcaggaggaccatttgaggtcaggagttcgagactagcctgacaaacatggtgaaaccctgtctctactaaaaatagaaaaattagccgggagtggtggctaacgcctgtaatcccagctacttgggagggtgaggcaggaaagttgcttaaacccgggaggcagaggttgcagtgagccaagatcgcaccattgcactccagcctgggcaacaagagcaaactctgcctcaaaatgataataataataataataataataaataaaagtatgcccgcagtgtgggacagactacaaatagtctcacactggttcagatcaagttttccaccaaatcaattaacaaaagcagcatttggttttcagagccctttggatttcagaattgcagataaaggattatagatcagaaatactttgctcatcttcacttcagtcccttgagaaaactggggtttggatcagtgttaatactgctctagatacaagcaagggtctcaggaagaagagagcaaagcaaacaatgaaaagaaaaaggtcttcagcaacatttgctgaaaggacaacaaatgaagaccacgatcaaagtattaacaagctcaacaaaggtattaacaatgaaggtattaagaatggcacagtggcgaagaactcaaaatagttcctgagaaggcacaactaatgatttggttgctttactcacttgagcactagtcccttccaaccattccttgttctctcactcgaaaagcaaaaactaaaaggtctttttttggtaatgacgtaaatacaaaagcaagatctatcaattcatgtctatttcaagttaagcaatgtaattaagatttattaaagatttttttaaaaccacgttttgtaagcacactgtttcctttaattcctgatctccttgttctcatctggtgtagtttttacaataggtttggatctaaaacagcactgtccaggagaaatataacacaagccaccaatgtaggccgtatgtgtccatttaaaattttctagtagtcatattaaaaagtacaaaacatgccaggagaatgttttcgctcacacctgtaatcctagcactttgggagtccaaggcgggtggatcacttgaggccaggagttcaagaccagcctggccaacatggtgaagccccctctctactgaaaatacaaaaatgagccaggtgtggagatgcacacctgtaatcccagctagtcggtaggctgaggcagaattgcttgaacctgagaggcagaggttgcagtgagctgacaccgcaccactgcacttcagtctgggtgaaagaatgagactcatctcaaaaacagtataaaacagtagacagaattttaatagtatactttatttaatctaacacatccaaaattcttttctctcaacctgtaatcaatattaaaattttattaatgacatttatggttttttttttaatactaggtctcttagaatgtgttttacaattaaagtacatcctaattcaacctaggcacattttaagttctgcagagccacatgtaattagtggctacatattgcactgtgctggattagagtcttcagagtggtgactacatacagcctataataaaattaattggttccttttttagtttacatcactgtcccctctatacctgtcaccttcaggcttacctcagatcgatcaggctcactaaagcttcaaacaaatgtcttttatttggtctttctttcttccaagctatatactatttaattctaatatgaagttaaaattacttcacacacacacacacacacacacacacacacacacacacacgtcttagatgaaaaaaactactttttttcttcttgtcacatttgcaagtttacatataaaacactagctaagaggttagttagaaggagcaacaaagacctgattctttcatttattttaggctatgtcaaaaaggaagtattaagaccatagatatattattagaaaacccatttctgccatctccttagccctcctgcttaagacacgctgcagtctagatcagccatgtactaacaatggttaaaactaggtagttcatggtcgtctctactctgctttctatactctgacattttccataatttttaaaaaatgaagagaaaaagctaagaagcaagtccaaggacacacaaataataatgatgatgataactgctgttattaataaatgctattattggccgagcgcggtggctcacgcctgtaatcccagcactttgggaggccaaggagggcggatcaccaggtcaggagatcaagaccatcctggctaacatggtgaaactccatctctactaaaaacacacacacaaaaaactagccaggcgtggtggcgggtgcccgtagtcccagctactcaggaggttgaggcaggaggatggcgtgaacccgggaggtggagcttgcagtgcaccgagactgtgccactgcactccagcctgggcgacagagtgaaactcagtctcaaaaaaaaataaaataaataaataaataaataaataaataaataaataaacgctattatcatttttgttagtatggtatagaaaggaattataaggatcctccgaagagattaagggatcaccagcttaaacaatatctgactgtgagactttgcatctaaacacacagataatgtattttccttcacacaaagtccaatttctgaaatgtttccttccattacttttgtagaggtgacactattagaaaactgacttctccactaagtatttctcttgtaccagccacacaatctttttctaccgggcacaagttaaccatagtgaaataagaacatgttgctctgtcttaaagaaatcactattccatttctcatattcctgtaaaagttttggacaggttactaggtctataaatacagtttaagctccttatgtttaaaataacacaaatcctggcaaaagcttgtttgtatattctgaacccagaacaaatgaaccactttaggcaattccaaaagattacacttatgctttaaaaactgtgccaatgttaattaaatctgacaactcttaagggtgtacttcactgtattacctcagagtggtttaattagttaaactgaaattaggcttctgtcacttctaaaatctaactccaaatctgaaccagagtctccagtggtttcagctgctttgaccacactgtggcacattggtttaacattctgaaatattctaaaccacactgagaatataggctacaagaggaaatagacgtgggttaaccataacattatctgcacaaagaagaagtaatggcaaatcttctacagacatcacatccagtttttgagtcatttcatcagctcattaaatgtcaagacaggactgcccatgcaatcttggaatgcagccagtctactaccaaaattgctgctatgcaacttcacttgacaagacaagttcaaggaacagatgcaggaggacaaccaagcaaccaccataaaatgtgctagagttggaatgctataaagttctagaagagaaactcaaattatgcccaaaatgaaccactcctcttctaatgttccagacaatatccaaaacaagcagtgaattaaaagcttatacataaggaagacagatatgactgagggttggggagcatattttttctgatacaacttcatagaacataaaatataatttcacacaaatgggattttaaaacacagaatatttatccacggaaataacatttcaatcatgccaaatctcactgagatgacaagtataaagaaatgctttggacccagtaggtgaagtaaagggacaccacacacctgtttgagagagaggtaggggcaattacagtgctatattcaaagccttttaacctacttcaagatacattaagtctgagtacatataagtgattttaaatatgaaaagaattgaagtatcatagttactctgggtagttttataatattttttgcaaggaatcaggcattgaatattaaagatttgcaattactatgctctttttctgttagagctaaaaattgctactgtgaccaaagctttctaaaacctgaattactccaggaaacgaaaaaattgagaacagagttccagatgaaggcatcatgatgacgaatgtcaacatcctggtcaattatactcaactgcttcataagacacttctgaaagcctcactgtcctgaggccccaaaaacctaatagggaaaagattaacatgtcaacaagggaaaactgccctctctgctctcattctttttaagcacagctaaaataaattcttttgtttttggggggacagggtcttgctctgttgcccaagctagagttcagtggcatgatctcagctcgctgcaacctctgcctcccagactcaggtgatcctcccacctcagcctccagggtagctgggactacagttgcacaccacaatgcctagctaatttttgcattttttatagagatggggttttgccatgttgcccaggcttgtctcaaactcctgggctcaagtgatcttcccacttcagcctcccaagtagctgggactccaggagtgcactaccacgcccagctaatttttattttctgtagagccggggatctcactatattacccaggctggtttcaaactcctagcctcaagggatccagggatcctcccacctcaacccttccaaagtgataggattacaagtgtgagccactgtgcccaataatcaactagcaattttcaaataggaattcacaaatttcattgttatgcgatgtaccccagacacaaaataacacaacaggccagcaccaggtttacaactcaatgaacattaagtccaaactccaggtgctctgctgagttgaggaatctaatgatggagtttatcaatatcattcttctctgatcatatgttatgaagatttggggagaaatatatatccatactaacatacagtacatgttgtgtggtaaagtagcacaaatgggcaaatatttaggtatttaaattagttattttgaatatttctcaaactgaagtataatcaatctttcttttttttttttaagcagagtcttgctctgttgtccatgctggagtgcagtggcctgatctcggctcactgcaacctccgccacccgggttcaagcaattttcctgcctcagcctcctaaatagctgggattacaggcgcatgccaccacgtttggctaatttttgtatttttagtagagacggggtttcaccatgttggccaggctggtctcgaactcctggcctccagtgatcagcacacctcagactctcaaagtgctggattacaggcgtgagccaccgtgcccagcctcaaactgaaggtataatcaattttaagaaacacaatgttacaaattggcaaagattcaaaaggaagtacttgttgatacttgtcatattatcagaacagccttatctcaacaatagatttattataatttcttaatgaggaattaatcttacaaaccaacagtaaaaaaaattatcaacaggttcctatatgtttttaacagtacaaaggctaagataccagacaaagaaactcctttaaaaaagaagtttgaatacttgggaaacaaatttccttattagggtattgatgaaataaaggaagttatcataggaaaatgtagccctgcaatttcaggcttagaatatgaaacagaacattcagcaaatgccaagttttcagtacacatcatacaaaataataccttctttattcaaaagttcttggtactaaaggttctaataaaccttgtttctgtttcccaacaaaggtgtgccaggtaaaattagatttgtacaaaactagctatggacattgtatcctcttaaagtagggaagcttactctaagatttaaagcaaatacacatgttcttacagtagacatgaaaatctctctttttatctatactatcaggtgttgctgcattgtcagtagaaactcagaaatgaaagtgggcaggagaaaccaaaataaaaagtatataatgaaaaaacaggtcgggcatggtggctcaaacctataatcccaacactttggcaggccgaggtgggtggatcatttgaggtcaggagttcgaggccagcctggccaacatggagaaatcccatctctactaaaaatacaaaacttagctaggcgtggtggcatgcgcctgtaatcccagctactcgggaggctggggcaggggtatcacttgagcttgggaggcagaggttgctgtgagccgagatcacgccactgcactccagcctgggcgacagagtgagaccctgtctcaaaaaataaaaataaaaaaggccgggcacagtagctcatgcctgtaatcccagggctttgggaagctgaggcacgcagctccaggtcaggagatcgagaccagcctggctaacacagtgaaaccccgtctctactaaaaatacaaaaaattagccaagcgtggtagcagacgcctgtagtcccagctactcaggaggctgaggcaggaaaattgcgtgaacccaggaggtggagcttgcatgcagtgagccgagatcgcgccactgcactccagcctggacgacagagcgagactccgtctcaaataaaaaataaaataaaataaaataaaataaaataaaataaataaataaatagaaaaagaaaaaagaaactgtgagagaaatttagcattgacaatactattgttttcaataaaaccaactattagaaacacactgattttgtcaatcagttaaatgggtatataacaagaaaagcaacctcaagaaaatttaagctaatagtacattcttaattttacaccatggcaaaaatgctttaaacctataaattatcaacgatatatcttggctattagtaagaagtactacaggccctcagtgcaacaaacgttttcagcagtaaaacctgatcctaaaaaaaaaaaaaggaatgctgttaagaaacaaggttgttctgcctactgcagggtcatataaaatagaaataaaggcttttgatctttcctctatcaaaaacatgaaaattattctttctgctaatgctttagtacttattatgggaaggccccacaacaatatagtaaaaatcaggagggggggtggtggcagaagtactgtgcagacaagtaaactaggtttgtccacaaaaggcaatgaagtcatttcagcataatgaagaagagacataaacaagtactagcaggcaccttttaaattttaacacctacagataggtggccactatcacctgacaagtagggaaaacagacataccctcacatatatgttattctattaaagcaggagccaaataccacaaccatcttttaaaaaatgtgacatcattagcaatgccctacgctcaatccctccttcccgaagcttattataaacctgaggttaaatctattcattctttctacaactctgtacaatataaaaacacatctaatacccagaattccccattccttctccctggtttccctaatgtagccagcatctggtcacatcaccacttacaaaagaggaagtgagaagctgatctaaagaatttccactaagcgagcaggtagcataaatgaatgaacacagtgagactttcccatgtgatccactcaagacacataggtttactatgtcttaccttgctatataaataatttaccaaataattatcttttctttccaaatgtactataaacacatatacaacagtgtgagcccaaacttttttttttttttttttttttagacagagtcttgttcttgtcccccaggctggaatgcaatggcatcatctcggctcactgcaacgtctgcctgccgggttcaagtgattctcctgcctcagcctcccgagtagctaggattacaggtgcccgccaccacgcccagctaatttttgtatttttactacagacagggtttcaccatgttggccaggctggtctcgaactcctgacctcatgatccacccacctcggcctcccaaagtactgggattacaggtgtgagccaccgcgcccggccaaccaaacagactcttaagtctttcagaagagaacagggttatcacaaccataatctgatactctgttatagtcccagcgaaaagcagctttcattctcgggcatgacaaaagctagggagctttctaaggaaaatgggactagaagggagaatgtcacccagactggggttagatcagtatctggaatcagttgccactaacaaaaggctagcaaatacacttcttggaaaaagagggatttttaaaattatacatctttgtaaaagttttcaagttcacagtattatcaaatcaagggagatgaaaagctggtagtagcagttgctcctagaatcactactagtctcaggatggaaaaccccagattttctccccgagttatgcaggactaatttagacgaagagctgcactctttctttagtttgccaagtatcagattttacatcaacataagaagagaataaataactatatgctgtatttcctagacgtgcctatgtaaataaaatgacaaaggctctgatgtcctaatagtgaattaggacatcagaatctccaggggaaattataaagggaggtcttcatgtatacagaagtaaatttaccacaaacatcaatctataaaaaggggacaaaaaacaaacagcagttgtgttccagcaaacctagaaggagaaagatggatctaaaaataagatttatgggtgacagagcctttgcagattaaaagaacgaatgaatgaaggaacaaatgaacgaatgaacgaatgaatgaaaaaaattaaaaacaggtttaaggatgctggtaccatacagggaagaaggaaagaaggggtgacggagccaatgacaccactgtatgtatgtgtctgtatgtatatatatatatatgcatagctcaagaaaacataacaaagaggccagaaaaggaattctaattttaaaatctactgcactcactgcaaactaggaaaataaatcctatttaatcaatgttatatattgttatataaagtgtattaatttttattcttaaagatggtcactcagaacctccataaattgtaatgtctttatctgaatcccttctgaactatttgttattctgaataaatttctgtatctaaagtattatacctaaagtgaggaaaataagacttgaaatattcccagtaagaaacaaatgattttattttcaggctaatcagtcagttatagcagactaagatgggcaaaaccaaatacggaattttaaaaaccctacatgataataaatttggtgcattcccttacgtaaattttcttgctacagatattcttctaaaacttatgggctttaaactgttttcctaagcatactcgtacctatacactcatgtatagttcataatccacaggtgtgaactagatgggattaggtaggcaatctatattcaagctgaccaaaatgaagctaaaagcctgtctgaaacataaactcataacctttgtctcatcagcaatgcactccaactgttaaaagattcaaacatcaacttggatttgaaaagagtgggaggcagtgaaatactaacagggagaaaatttatggagtctatgcaaaattttctattaatgaaaaccagctgcaagaacaacagatgccgttttcagtatttgagcctggtggaatactaacggggtttcttctattccaagtttccattttggaagcaaggccttgaagtcattattccctcagggtcatgggcactctacagaatacctttccaaaacaactgttctagagtctgaattttctgtccattagatgtgtacagtgtctctctgaagagccatttaaagccatccttgtatgtgaagtttcccccaaaggaaaattgagacctaactctgttctatctatgtgatccataagacctgtagcaaagtctaattcaaagttgttaattttagacttaacaccaatatcagggatataggccactaataaaacactgtgataaaatattaatcactgattattttcaccataatctatttgattgccacaaacttaactctaccacttggtaaatattttttcccaagctttggttaattagtcttgttcccacacagcccataaatcaattttaaaattgtttgcatgtaaccatcataatatttaatatattctaccatctgccccaacaccagttaacagcaataaaagatatagatatagatatagatatagatatagatatagatatagatatagatatagatatacacatacatgtgggctttgttttcctaacttaggacagccagttcttccagtatagatcttacataattttggtttgcagaaattgcccctaggaaattcagaaagtggctttacccaaaatgaggaaaatcacttacataagcttttaagactagaaactgatcagcagccatttctcataccaatacatctctccatcctaggattatgtggaagagaatatattatccctagaatcatgaaggttgagtaaaatttctgtaaaaggtacctttggcaccccagacaactgttaagaaaaaagaatatctgtactcaaatcattatactgtcgactcaaaacccattataaaagtggcttgaaaatgaaaaagcaaaaaacaaacctcaatcttgtctgttttggcatctccccagtatattttgccttcatcataatccaaggctaaaccatttggccaaccaagagaagtgttaaccaatactacacggtcagaaccatccagagctgctcgctcaattttcggaatttctccccagtcagtccaatacatgtacctagagaagtatacaaaaaatgagctaaaaatagataataaaatgtaactttcagatattctaaaggtgagatccatccctcctattacactggtatcatcagttaatgccaaggaaggggaaaaaaaaaaaaacatatgaagaggtgtttaagacatttatcccagcaatatataagattgtgggaaattttcagatcagtgtgttctagagccaatcctgaaaatgcctcccaataatgagattacagttttacttcttttttttttttttttttttaaatattttgtgtgcccttttccatgaactttctctctcttttccttgatggcttgtcatctctctgacacaaaaggcttatcccagcagtattagtcagatggcaaactgaattctcaaaataactatttcttcctgcagtgctaagtgattcttacggctcctggatgtttagatggctctaaggcattggtatatactgaggtgtaatttgtcactatgcttgtcctcagaataaatctcaaagtaacaaaattgttgagtatgtaaaaagttgtacttccctggactatgatcagggtggcatggcaaaacaaaacaaacaacaacaacaaactagaagtaaagctgcatgggctggcaaagttttggaaatcaagtcattcatgtatttagggaaaaaaaagtaagctatattcttactataaagtactgaaaatggaattaaagcttctaggggaagggaaagagttctgaaaacaatttcttcccacatttttcatggtaatgatgcaatccgagcaaaatctgcagacaacacccaaagtcagcaaacatggacttaatttagaaagaaaaaatatctaagacatccaaggcaaaaaactagcaatttttaaacttgagattgtattctaatcaccatatcctaaaatagacagccattaaagagctgtttactggaaaccaatatatatgtcatgttatcttagtcaatgttttcaggaacctgtgaaaaacagaaacaccacacagaatttactatcagtagagcttcttacccaaccatgggatctaacacaatagcccggggttcctctaagtcctctgaaatcaagatcttcctcatggtcccattgagccttgtcacttctattcgatcagtgccagtgtctgtccaataaagatttcgtgcaacccagtccacagcaataccatcaggatgggcaatttgagcagtgaccacaaactgactgccagatccatctataaatgaacggcgtatggccctcacttcatcatcagtccagtagatgtagccttccacaggatcgtaatctatggcaatggcatgacggatgtcttctaactgcagaacaatgtctgtaaaatctggtgtatccaaagaaatgcgtctcaagtctgtccttcgagctaaaagcaataattctgtggcacctagaacaacaaagtgaaatgaagaatactttgaaacccagaggtaaaatttacctgctctagataaagaatcaagaactgaaaaataaatataaaatatacataaattaacacaaaaggatgtgcactctctttagagtggaaatggaaagtaatacagtgaaatagaagagtctactctgaggtcaagctgtttaatggctaactctccaaattaagttgtgatacattctatggtttcattggaattaatccagctatttaaaagtacaatgaataatgactatgtaatgactaagaagctaagtagctcagtattaaaggagaaggaaatgtaggatatagatcctttgttcaagaagcattttttaaaaaaagataaagaaatttaggacaagaatctttgtgcttgataggaatgttctaaaattggattgtggtgataactgcgtaactctgtaaatttactaaaaagtcaccgaattgtacaatttaaaaaatggatggattttatatgctatgtaagttacatctcagtaaaactgtcttaacaaagagaaatacagggcaatacctcacagaattgaggacaaagcaagctatggagaaacaaacagctgcaatggagggaaggaaccagataaacataacacagtggttaagagttgtggatccaatataatttgattcaagaagctacacaaactttgggaaaatatctaatctcgctaagcctagtttccccatctataccttgtaaggttgttgtaaggattaaaggagataaatctaaaactcaggaaagtactgaacatttaagtactcaagaaatattaactaatacttaacaacagtattaaaaaataaagattttcagatttttatttcactgaattttaaattaggtttatttatgaactgtttaaagcccaagccccaaatacttaaccacataaccaagaatgaagatactgagctcaatctttttttcattttaaattgttcaagtaaaccaccagcaaaaaatcgtctaactataggaagctaataaaagacagtaagcaaattgacaactgaaagaataagaaaagattcccagctaaataaatgagtccaaaacaaaatactggcatataaacttcaagaatcaatctgcaattacaagtcaaaaaactgagaagaggagtgaagcctctcaatatcagccctttcactctagagctaattataaatgaattccaacttgaagaaaatacagcccaaatgccactgcaggaaccaagtaggaataactttgtacaattcactgccccggctaacaaccaaaaggagccagcctagaacttcacaaagaagtcatagagctgttaatttgagcaaggtgatcaaaacagaacagttaacttaaggctactacatgccaaatgcacacatgaaattcaaaactggttaaatatgtacacttgcactgctgtgagggagcagatagaccattattgctaaaataaatcctctgttttaaagtcaggctacatttttaaagaaaaaagcaacattacaaaaaccttttgttttaaattgaaaccaaattgctgtctgccatggaaaccatttgaccaagagtcagccagcttcaccttttactatgaggataatttatcaatgccaagtcataacaaacatcctgtacacagactcaattccatctctctgactccctggcccccttgccagggactctaacacactccaaaacacaggcttctgcttttcagagttagataaagaagccacagctaaatacaacaattttcttaccaggtcttgctggttgctagagaaccagatggtgatccataggggtgagaatgaagaataacattctcattaagaagaaaaacagaagaactggtgttcttccaaactggaagtcccttaaaatgtcctaaatcagtatactttctccaacgtgccctctctctatagggaattaagagtaaggagaacaggcaaagtgtgtttcttaagtataaaaagaagttgttttaaatatggattttttttcccagctctgaaagcatctctctgttgttaaaaagcaatttaaaacatccttaaataatttgttataaaatatatctcatgatattctttgtagctaaaagtttaataaacatactttctttcacagaggttctttattcacaaatgctacctgttaaaaatatattccttatgcgactactcatttccatagttatcaactgtgatatcaatgactatgagatttgacagaaaagatacaacacgtaacttttttcaaaaatatgttatttaaaacactaaaataatttataaaatagcattcaagtgatgccacagaacaaaacactcctattctataaccatgtgtgaagactgtgaaattaagtgactggtctcccaaagcagtataacctagagagctgattatagagaaaacaaatcatgaagaattccaatagttataaaatttttcattttggataatatcttcttaccatctttgcaggtttttccattctccaggagtttgaccccagtggggcaagcacactgataaaaaggcttgactggagacatcaaacacaaatgggaacaacccccattgtcaattccacatggatttgtggctgtcaaatataaatcacattgattaatatcaatgattactaagtacacaaaggttaacaaccataacatgaacaactgtgataagccaaaattattaccaaatgtcatgcaggtgcttgactatcaaaccatctgcaaagacaggaattaatcagtgtgaatttacttagtattttgtaaccaaagaggaatacacaagaagtaaagcaggagatccctgccctaaaagaggttacaatttagtcagttaaacaaaattaacaaaaagcaaaactaaaaacaaacaaacaaacaaacaaaaccaataaaactaagtgctattttgcacattatagacaataagtacagagtcaaatgggaaaaaaaccgctgaggtttaaagaattgaagaagagctttgtggagtatacagcacgggagccttcaaggataggaaggatagataagaggacatttcaagtatggtaaagctatctgaataaaactttgggggctataaactgggtaagatattaaggtgaacagtataactggaggttaaggtttctactgactaataggaactaaagctgaatgaatacaaagaatgggaatagattaaagtgaaggacactgaaagccaagaaaagtaattatgttgaaaagtcatgccttgggaagattaacatagaagggataagcagaaaaaaggggaaaatgaaaatcagagaaaactaattagcaaactttggaaattatggaaagggatatgtccaaacaatactcatagaaaaaaatcaacataagatggagaccaatggaacatgaaagataaaagtaaccaacatgaaagataactgcaaattctcaaattagtaaaacataaaggaccaacaatgccatttaaaaagaaaaacaagaggccaggcacggtggctcgtgactataatcccagcactttgggaggcctaggtgcgtggatcacttgagcccaggagtttgagaccagcctgggtcaccaacatggtgagaccctacctctataaaaaatactaaaattagccaggtgtggtggcatatgcctgtagtcccagctactagggaggctgaggtggaaagatcacttgagcctggaagttcgaggctgcagggagccgtgatcacataaacgcacaacagagcaagactctatctcaaaaaacaaacaaaaaacagggaaaattctcttttgagggctatgaagaataaaaaaattcatacaagtgactgaacattttcttttgtacagaagagtaacacatacacttaaaaacatttttatgggctcatgatcatcagattccaacataacactttcaatatttgattatctccccctaaatggagagctaatataaagcaacatatgttgcaaaatctcttcatttttggctatgtaataaaatctgaaatacactcagacagatgccagacatttatttacacaaaagtgccaaacccttaacattctcgtattccttttaaacctaattccagtcctctcttacaagttctcagcagtcatagcccgagtcattgtaaaggctgaccaaacacagaaccaaaactaaggaaaacaaggtgggaggggtacacagaaaagtttaagtaggtattttatttagcaagctgaggtacttaaattcaaatatattctagattaacagagttttcatttaaaaagaagaggcgtttttgtgtgtgtgtgtgttttttgttttttttttttttgagacataatttctttcttgttgcccaggctgaaagtgcaatggcgtgatcttggctcactgcaacctctgcctcccgggttcaagcgattctccagcctcagcctcccaagtagctgggattataagcacacgccaccacgcctggctaatatttttgttattttagtagagacggggtttcaccatgttggccaggctggtctcaaactcctgacctcaagtgatccacctgccttggcctcccaaagtgtgggattacaggcatgagccaccgcgcctggcccaagagtttgttttttaaacacactcacatcaacacattcaactacatactgaaagaaataatatgaacaaaaaaactcatttgtgtataagcctagcatataagctatctcaatttttaaattatctctctcttctccacctctaaaagcgctgactcaaaaaggctgaggtggtctgtagtgacaggctacaaaatggtctaggctattgcctaacctgaattatacttttacattttcccttttttttgagcaaagtctcgctctgttgcccaggctggagtgcagtggcacaatctcggctcactgcaatctccaccttccgggttcaagtgacactcctgcctcagcctcccaagcggctgggactacaggtgcacactaccacaccccattaatttttgtattttttagtagagacagggtttcaccaggttggccaggctggtctcaaactcctgacctcatatgatctgcctgcttcagtctcccaaagtgctgggattttaacttttttttttttttttttgagacacagtctttctctgtctcccaggctggagtgcagtggcgcaatctcagctcactgcaacctcggcctcccgagttcaagtgattctcttgcctcagcctcccaagtaggattttaactcttttttattcccgccaactatctttggatatgccctccctcctcctgatcctcactaaagccagacattagagtgctacaaagctgttccaacttgcaatttaaaaatcaaggatcacttaccatttggctgcctctgttggctgaaggcatgtatatccatgggagagaagatgtcagaatggatttcacgcagaccctcaccagtatacttgttgcaagccaaaatggagtgtgtgctccagtcagtccagtacaatatgtcctcaaataacgtcaaggcaaaaggatgtggaagggaacctttaaccactgcctgcctattaacataaagagaaaaatttaaacttatttctaaattttcttcttctatcataacgtcacctctcccattaaaatgatcttagttcacattaacacatacaaatcttgagtaatacataccaataggtcaaatacacctataaaaaataattcacataatgaattcatatatatttttaaggtgtccaaaagccccaaacaagcatttgggaatagtccctaacttggcagcagcctcaagttcagtacaagatacccggcagagagagagcactgctttttcattgtttgcactgctgtcaaatcctactcttcaactaccatctctggactcacagcttccaccctttcacacaattcatgtcatcagacagagaaaggtaagcaatgagaaaaatcacaggggttacagttggcactgaagtagatttatatcagcaataggttttttccttcttgatgtggaagaacaaagaacctgagcctgttttgtccatcacttcttatggttttgataactgagaatgaaacataaacatgaggccaaaatggcatgcaggtagcactctccccgcaaaccccagtctagctccagcaagtgatcatcttagctgacttttcactatattcaggcagccaaaaagaagtcctgttagtggtagaatatgttcatgagacaaagcagatccaaaattttcacaagcaatacatactttttaaaaggaaaagtagacagcctagttagtacttaaggcacagaactttgtagagtattagagagagttatagaataagcaaatgctgagggccgggcgcagtggctcacgtctgtaatcccagcactttgggaggccgaggtgggtggatcacaaggtcaggagttcaagaccagcctggccaagatggtaaaaccccatctctactaaaaatacaaaaaaattagccaggcgtggtggtgggcgcctgtaatcccagacactcggaaggctgaggcagagaactgcttgaatccaggaggcggaggttgcagtgagccgagatcgcgccactgcactccagcctgggcgacagagcgagactcatctcaaaaaaaaaaaaaagaaaaaaaaaagaataagcaaatgctctggaataatgaacaaatcacgttttgagtcaaaataatattcaagaaaatacatgttttgatattttcataaatccaagtttcccaatagcccacccaggaggcagagatgggcagagagggaggaagggaaagaaaaatgaagggaaaagggaagggaaagcataagctactgaagagaaattaaaagtatcatatattttaaggaagatgattcaattttcaggtccttgaggttaactgatgatttctactatctaacagactaccagcatattaaattaaaagcaattaaggtcatttttacgtgtaagcaggattaccgtctgtgattgcacatggaatgatcttagtctaaagcattataaattcagacaaaatacctgcactgccaacccatatcaccagttttctcattttccttaatcctctcttccctaagtaaaaagctcactattccttctaatttcccaaagagaactgtcacaataccttctcctgaagtgctttcttccactttttaaatggacagttttattaaatttactaaagagactatattatttacagggtgatggcacagtttatgttcaattttaaacaggcctgtatatttcacactaaagtcttccaaaattcatggtggaaacagagagagaactgagaaagctgccaaaaaagacaagtaacacaaatgaaaaataaagagtagttaaaactaagttacttggcatttcaccatcttaaagaactgctttgaaaaactcaaggaaaaaaaaggcttcaaaaagttttgtatatcattaagtgaaaagttgaaattcactctactgaactaaacataggaaaataaacatatggaaaaggcaaaatccctaaaagctatattcattttatatattaattgaatgcataaacttagaactcagaggtgagcttaaatccccccttgacacttattactgacaccatttctgcaagctttatttcttcatctgtcaacggaaggtaataatctatcctcactgcgttaatgtgaagattaaataacatacgcaaaagccattcagcactacgcttgctacttaacactttcgttaatgattcctcaattttaagacacatattttcaatattttaacatttctgatataagggtaacatttacaatgtgaatatttcatgtggtagtttttaaaatcagtaagttcttaaaatcaatggcttattagaatcagtaaatactatactaatattaattttttttttgagacaaagtcttgatcttgtcacccaggatggagtgcagtggtgtgatcctggctcactgcaacctccgcctccagggttcaagcaattctcctgcctcagcctcccaagtagctgggattataggcatgcaccaccatgcctggctaattttgtatttttagtagagatggggtttcaccatgttgaccaggctggtctcaaactcctgacctcaggtgatctgcccaccttggcctcctaaaatgctgggattacaggcgtgagccaccgagcccggccttaacactaaatataaatgtcactttcttttcatagccattcttaatttcctcccgccacaagccaagttagttttctttctctacgttctcataacagttagtgaactgttttataactgttcacctatccagcaactctataacagatgacctttttgagagtaaaactctagcttatttatataccaaggatcccacacaatggtaaggtgtacaaattaggcagacttactaaacactctggggatgcttgataaaattaaatgtttttaagaaaatatgtaattaacagagctgaacaaaaggcagaactaagaacactatcatgcaagggtgatataatgatttgtccagccaactatgacttgttcctgaaagtagggataaccacacagagtattcccctttcttctctctggctgagattaccaagtaagcctacctcctgatccccatctggaaacacaagttacttcaaggaggagttgatcatggctgctaagaaccaagctggcaggtaagatccaagcccagttcctcaatagtaggtcacaacgataacagaaactaaaaaatggatcaccaaactggggaccacagaaaagaaacagagactccccccaacctcactgaagttttcatatagtgcttgcaatctctgagcatcatctcctgcctatgtctgtcacattctgcaacttactgataaagctcaccactgccaatacctcccaggcacctcttgctagctctttgagattctttgaactctgcaagtggttcttttaaactctgcaccaactggacttatcctttataaaacacctgcatgccctcatttagtttttgtttctggacctcctcacagatagtcatcttctgctcctctctcagaactgcccacttgtgtgagtaataaatctttctttaatcataccacaggactgctgtcatgagttctgacatctgaacttaaccttggaaggaagcttcccttcaccacagtgaagctgtaataatatctaagaagacaatgtcagcagtgatggcaaagctttggaaaaatctccatgaatcctccatgtgaaaacagagaacaactaggtaatgaaccccaaatcccatggacaacattcacaacaaagctaggtaaaacccaagatacaaaatggtagagaaaactaccaacagccattaagatatgactgatattggcacctctgcaggatatgagaaagaaacaataggacatctggcaggacagaacacataaaacagacaacattggaaagcttagtagaccaatctgagaacagcaaccagctatgaggtgttctggccacttcaagagtaagtgaatacaatgaattcatcgtcaggcactgaaaggtctagcactatactttaacctattgtgaactctcaaaattgtccttcccgggctcccttccagacaaagcgtcatactgaagagaaatcactgggagcggactgaaaagtgtgcatgattggtacaggagaacaatgggaaaataaggtacagaaaaaagcagaaaaagtaaagtgggagagccaggaaatccagaaagctagctgccattattttttaaacacatatacatagacatgagagttctgtgaaactggagaacttatgaactctgccttcttctgaatgttcaagcaaaacagtttcacctgaaaataagaaaacaaattactaacatcaaatcccattaataagttaatattaaaaataagaaaaggataaagtgaagaataacattcctacagacaataaaaaagtatgccagaaagatatagaaatagaacaaattaaactgataacttatttcaaaacagtcaaagtatttaaagtaagatactagtcataaatgaacaacacaaattagaatcagacaactcacaagtgaggggacagaacttgaaagaatgagaaatacaaaaatacatcatttcagaaatgaagtctacgaaataagaatgaataaacataatacataaagaaaaaaatgaaaaggaagaaatattacataatagaaaaaaatattttcaaaaaataaaatatttgaaggacaaaggacaaggaagagaacagaactatactggaacaaggaaatgactccagatggtaacttgaaccctcaggaaaaatgaagaataccagaaatagtaaatatgcaggttaataaaaaagactctataaataatgttttctctttttcctttaacctttttaacagacataagattgtataaagcaataagtataaccctgtgttagatataatagaaatgaactataaatgacaataatagcagaaaggatgggagagagaatggagatatacttagagtaaaatgtatgtacttttcataattaagttaatattaccacaaagtagattttgacaaaatgcacgttgcaatccctaaaataattacctttaaaatccccaaaatacagtttaaaattatcaaccaaggaatcaaaatgacacaccagaaaatatctacttaatacaaaggacaaaggaacaaagatgacataagataatttaaaaaaaaaaaaacactaaaatgtcagacataagcccaaccatatcattaatgacattcaatgtgaataaacacaccaatcaaaaggcaaaggctgttagactgaataaagcaaaggttacactatatgctgtttataaaagcacattttacattcaaagatacaaatagattgaaaagaaaaggttacagtagacagtaaccataagagagctggagcagctctatcagacaaaaaagattttaagtataaaaaggtaactagagatacagtggcaggttttatgagaaagagtcatcaggaagttacaattagaaacatacaggtacctaaaaacagagccccagaacaaatgaagcaaaacctgacagaaatcaaaggaaaaatgggcagttcaataatatagttggagagctcaacaccctattctcactaaaggaaagaacaactagatagaaaattaccaaggatatagaaaatttgaacattattaaccaacttaacctactatctatagaacattccatgcaacaaaagaatacacaatcttttcacgtacacgtggaactttctccaggacaccacatgctaggagacagaattaatcttaaaagactgaactcatataaaataaaaagactgaactcatataaaatagactactatctgaccataatgaaattcatgaagaaatcaacggaagaaaatttgggaaatcaaattattttctaaatttttgaaatttctttctcaatttcctctaaatcagcaatgagtcgaggaagaaattacaataaaagtttttaaatattttgagctaaaagaaaatgaaaatacaaaatatggaaacgtatatagaatactaatgcctatactagaaaagaagagagattacaaatcaattatttatgatttgaccttaagaaactgtaagaagagtagattaaatccaaagcaagtgtaaggaagaaaataaaaacattagggttaaaaaaaaaaaaggcaatgaaacagaaaacagaaaaacaataaagggggaaaaatcaataaaaccagaagctggttgttctttgaaaagacccacaaaattgacaaccctttagtgctagactgacccaaaaaaaaagacgcaaattgtgaaaactgtgaataaagtgatgaatgaaagagaaacactgccttacagaaattaaaaggattattaggcaataccataaacaactttatgccaacaaattagacaaatttatgaaacaaaaatattcctggaaaaaaaccaaattactaaaactgactcaagaagaaacagaaaatctgatagatctacaacaaacaaggaaattgaatttgtaattaatatcttcccaaaaagaaatccccatgcccagatggcaggaaaagttgtatcaactggtcacacacttttccagaaaacaaagaaagaggaaatatcttccgactctatgaggctgatattatgctaatctcaaaaccaaataaacacaagaaaaacagactacggattaatatccttcactattaaagacataaaaatcctcaacagaatattagcaaaccaaatctaacaacatttcaaaagaagtataaaccacgaccaagtagaacttaccccagaaatgcaagatcggtttaacaactgaaaaccaattactgaaattcaccatgttcataaaataaagaataaaaccacataatcatttccatagatgcagaaaaaggaacggacaaaatccagtaattattcatggtaaatctgtccatgaactaggaatagaaaggaacttcctcaacctgataaaatccctttattaaaaaaacctacaggtaatatcatgctcaagactatttttaatcttttttaaaaaataaagccaatacagagaaaaacatacaaaacaaacatatagcttaacaagttactataaggcaaacactcttgtaaccacgaattcactcagatgaaggaaaaaaacttgatctgggtgaatcacccagacgacttcaaaaggccctgcatgaaccctgtcccaatccctccctctccatagaagtaacaattattctgattttctattagtcactttcttgcctttatagttttattgctttttgtaagtgtgcatccacagaaaaatagtttagtcttaagccccattttcatttgctatttcttttaaagtctctgttttaaaaaatgtttaactggtacataataattacacatatttgtggggtacacagcaatgttgcaatatatataaggtaccgtgatcagctcagggtaatcagcatatccataatctcaaacatttaacatttctgtgttggaaacattcagtatcctctttgaaattatataatgttttacctattaagtacagtcatcctacagtggtatagaatactcaagctttttctaactgtaattctgtattttttagcaaatctcttcttatctcttccttcccagcctctagtatcccctattctactctttacttttgcaagatcaacatttaccttccacatacgagtgagaacatgcatggtttaattttctgttcctggtcctatgtcacttaagataacatcctccaggtctatccatattgctgagaatgacaggatttcattctttttatggctaaatggtattccattgtgtatatataccacattttctttatctattcatctgatgttggacacctaggttgataccacatcttggctactgtaaatagtgctgcaacaaacataggggtgcagatgtctcgatacactgatttcctttcctttgggtaaatgccaagtagtgggactactggatcatatggtagttctatttgtaattttttgaggaacttccatactgttctccatagcggctgtactagtttatactcccaccaacagtgtataagagttcccttttctgtgcattcttgaccgtattattttttgtctttttggtaatagccatatggtaactagggtgagatgatacttcattgtgaatttaatttgcatttcctggatgatttgtgatgttgagcattttttcatatgtttgtggccatttatatgccttcttttgatacatgtctattcggatcatttccccattttttaaccaaactggttttttgctgttgaactgtttgagttccctgtatattctggatattaatcccatgtcagatgagtaatttgcaaatattttccctcattctgtaggtcgtcttttcactgtgttgtttcctttgctctgtagaagctttttagtttgatataatgcatctggtattttttgcttttgttgcctgcatttttgagatcttatccataaaatcctttcccagaccaatgtcctgaagcatttcctctatggtttcctctagcagttttatagtttcaagtcttacccttaggtctttgatccattttgagttgatttttgtataaggtgagaggtgggtttctagtttcattcttccacatgtggatatccagtttccccagcatcatttattgaaaagactatcctttccccaatctatgttcttggcacttttgtcaaaaagcaattggctatagatgcatggattaatttctgggttttctattctgttccatcggtgtatgtttctgtttttatgccagtaccatgctgttttggttactacaactttgtggtatattttgaagtctgttagtatgatgtctccagctttgttctttttgctcaggattgctttggctattcagggtcttttatggtcccatacaaattttaggatttttttttttttctatttctgtgcagaatgtcattggtattttaatagggactccactgaatctgcaggttgctttgggtagtacggtcattttaactataataattattccaatccatgagcatgaaatgtttttccatttgtatgtatccctcttcaatttctttcatcagtgttttgcagctttatctgaagaggtctttcacttccttggttaaatttattcctaggtattttattaatttcttatagctattgtaaatgacactgccttcttaatttctttttcagctagtttgttgtttgtgtatagaaatgctactgatctttttgtgttgattttgtatcctgcaactttaccaaatttgttgatcagttctaagaatttttttttttttggtagagcgttcaagtctcttttcctgtctgtctcttccttacaatctctccgttaaagtacctaagatatttcatttatatgtccagatctgctgatgtactctcatggtgcagttcaatgtttctctgtcctctgtatttcctacaaatggccagctgatatacagccttgaccagactcatgatgaattgatccctttgacaaaatagtaggcagtagtgtgttcttacaccagaaggcaaataatgtctgttctttttcttcttgtgatgttagtagccatcgacgctcaccacctagacccattcgttcaccaaagttataaaatggtggtattgcaattctgccatttctttttcatttatcaattgaaatagctctcccatatctactattttgttagccagaggtacactcacataggaaaagcaggataaattgcttctttcttgtatttaccaatgttcaaggtaataaatttgttcctatcatgctctaatctaagagtaaccaattcctttttaaaataccattatgaactcaagaatttaaacacacttcacaggtttctaccgatctctggccagtgggaattctacagtcatttctccagtctttctgaaatgaccctaaatagtctttaacagcctccttactaactgttatgacaatgttccagctcagcatgtacatttcttgcccaaaacctagaatcagcaattttgccagaaaggcttggtttcttttaaggtggaatggtttttcccaacaccacaatttgggtgctacagaagttcactgcacacagcactgtaaatgttcaattgctactcaattggtcatttttgatctagtcctcttcagtgttcacagtcaggaaacaaacaaacacagttgggtacatatatttttgaaagataaaatacctaataagcgcatactagtaagtaactttccattaaaatatggaataatcagtttgacttaacctctgcagtattacatctatacttcctctcttgcccattaagaatctagcatatgcaggagcaatatatgtcctaatactcacttacttgatgcaacaatataaagtttcagaataacaatattaattatgaccacaacaatgtagttactataagaattaaatttatggccaggcatggtggctcccacctgtaatcccaacactttggtaggccgagacaggtggatcacttgagtccaagagttcaagaccagctgggcaacatgatgaaatcccgtctctactaaaaatacaaaaaattagtcaggtgtggtggtgtgcacctgtagtcccagctacttgggaggctcaaggtgggaggatagcttgtgcccaagaggcagaggttgcagtgaacagattctgcaacctctgcaaaattcaagcaattctcctgccttagccccctgagtagctgggattacaagcgcccaccaccatgctcggctaatttttgtattttttgtagaggcagggtttcaccatgttggccaggatggtctcactcctgacttcaggcgatccacccaccttggcctcccaaagtactgggattataggcatgagccaccatgcccagtcacaaatcttcttgtaagaaactttttctatagttgttcatagttgttctattcccttgctttgcttttctttccaaagagtcttattatctgtatgttgtttcttctttgcctatcttcagtatttatcattttctctcaaatcatcttttgtctttctgtatttctttttggtctttaaatttttcctccttttcaacctctatttaaaggttttttggtttattcaacctagtgtcccttctagttttcttttctgaagtgattttttaaattctttcttaagttctatcatttcatttctgaatttttctcttttttttttttttttttttttgagacagagttttgctcgtcacccaggttggagtgcaatggcacaatcttggctcactgcaacctctgcctcccggattcaagcgattctactgcctcagcctcccgagtagttgtgattacaggcgtgcatcaccacgtccagcaaatttttgtatttttagtagagacggggtttcaccatgttggcaaggctggtctcgaactcctgacctcaggtgacccgcctgccttggccttccaaagtgctgggattataggcgtgagtcatttctgaatttttctaatcttatgttatcctttcacatgtcatattggttcctcaatgacttttgactcatttatttatttaaaatttaaagaaaaaatttattgaagatttgaaaaataattcctaaaagattgacttttccagaaaactagctacacaatgcatctcatctaccatgttaaaatgtgcactagacacaaatacaaaaaccatgcaacaagccaccattcttcaacaatttgagcaaagttaaatgccaaaggaacaacatggatgacttgcaaagaatgggctatttaagcaccatttaaaaaaaaaaaaggagcacaaatggatgagtgtgttcagttatatacactgaattgaacctttggcactaggaatcacagcattttgtcatatagcatgaacacatattataaaagtacgtagggtcaaaggaacaggaccaccagcattcaaaagcagctctgtcaactaggcaataaaacactctatagcatgtgtctctgttgtccattgttgaatacactggcaggaactttgaagtgaaaaaaaaggtaagataggaaaaaaggagctattactccttttattttctctgtttaaaattaaacaggaaaacatcaattgttgtacaataacatcttcaaagtgcatcatttgtacaaaagaaagactaagaacaaaaatgtgtttacagagatccaaacataagtgagtgagagcgtctctcagacagctttctgatggttctctggaggagccattcataattgctgggcactaaaaaatgttgcagaattctttgccaggtactttagggaactgtgaagataattcagtaataaaacaaggctcggccaggcacggtggctcatgcctgtaattccagcactttgggaggctgaggcgggcggatcacgaggtaaggagttcgagaccagcctgaccaacatggtgaaatcccgcctctactaaaaatgtaaaaactagatgggcgtggtggtgcgcacctgtaatcccagctactcagaaggctgagtcaggagaatcgcttgaacccgggaggcagaggttgcagtgagcttgagatcatgccactgcactcccacttgggcaacagagcgagactccatctcaaaaaaaaaaaaaaaaaaaaaaaaaaaaaaacacaaggctcttctcatccagaggtatataggccaacattgctccaatttgtacatcagtagatgtggtgctccataaaccttggacatgagtgcatgagggtgatctgcaagaatttcagcatactgtggtctgtcaaacttgcagagtagctgggtgcccaacatcacattgaagtattcttctatccctgccacaacttcattaacagcatactcattatctgtgtttccacgagattttttgcaatttgcataatcctggagaatggaatccacattcttcctggcagaaagaaaaaagagatgtttttgtctggtaattaagtcccagtcatcaacaagccatggtttcagctcttcaggaatcttcactttttagcttcaactctgttcatgaatgtgtcctcattttcaagagtaggatctacccgggggcccttttcttccaaggaggctgaggcatctcactggtactgccaccatctccatttccaggtattttctgtttgttcttttttgttttcacttcaacattttctgttgcagaccagatgtcttctttcttggggcagcccctctcatcttcccctctgcatactgctcctgatgggctttttgaagttgtttctgcaaattggtgtccacgtatttgagtactctgctctctggaacccatgcatcccaatttttattccaaccactgtaatatataaagtattttacttgtttgtcctttatggcaacctttacacattttgcttcataaagaagcagcccatgaaagcacagcacttgctcaccctcctggaacttagggtttgagtcctgcttccacgtcatttataagtgattcgcagcctcctccttctccagctcattttataatagagatttgatctgttctgtggtcatgtttttctggggtgcttttatttataagagcttttgttttttcctttataataactttaaatgggattttaccttgatacttttctgtttctcttgtctacgtaaaattagtgttcctgaacttttaaaataatgtagagttcaaggtagtttttctaacgtcacagaattcattcctctgttgttttcacataatgttcaaaaacctagtagcttgctttctgagatctactagccgttgatcttcccatctttatctgaaccttctctttccttcccctcctgttttactctattctattgtccctatcctgctcaatttggattattctatcctattcaattttgttttaatcagtgtggtgctctgtcctggatgagcactctggcaggttcatttcagtagttccattttgagagttcgttggggctagactgctctagcttcttctgtctttaccatagtcacactgcacttgcctaatattggagtgggcaaccctcccaccctcctatttcagctgctgttcttaaaataacccaccatcttgtccagcaaatagctgtggctattttggcgttcccctgctttcaagtcttatgagacaccctgttaaatctccctgcttactctcgcatagacagtgataacatggaggtcttgtggctgttggtggtttgcccttatctagttgtgctttcaaatgactaaggctatagtcaactttatccatgtttttggatttgctatctagtttctgtaggttttagttaaaaacaaaaacaaaaaaactatgacatggccacatccatcttcctagactccccctcacagccagatttgaggtcaaaaacagcagttgtttctatattcatcatatacttactttttgacatttaaatttacttaaaaccacattgttatatgtcatttcactcttttttgaaagaaggcaaaaaatactccaactccatgattacaaaaagtttaactgaattctttatatctttcctggttttcaatacttctaaatgttccttattcttagttcaggtaattgacaaatgtttattatactttgaaaaaatcctacagtcaccaaaaactctcatctggtgaggtctcagattgagatcaaaaaccaaaattatcattaaaacacaagaatccaaatataaaatgtctttaaaaatctgaacataatctgagaagaaattccatgtttatgttttacagactttgtcttccttgaacactgaaatgtatggtatatgcagtaggttttctccttgtccagagatgagcaaactacagcccacaggctcattctgctttacaaataaagttttacaccaggtgctatggctgatgcctgtaattctagcactttcggaggccgaggccggtgaatcacttggagctcagggcataagaccagcctgggcaacatggtgagacgccatctttacaaaaatgacaaaaattagcccggtgtgatggcgtgtgcctatagtcccagctactcggaaggctgaggcaggaagatcgcttgagcccaggagacagaggttgcagtgagctgagatcacgctactgcattccagcccggatgacaaggtgagactctgtctaaaataaatacgtaaataaataaataaagttttgctgcaacagtcatgcctattcccttatgcattactatagctgcttttaaactacagtagcagaagtagttgaaccggagatcataagcctaaaatatttactatctgagcctttacagaaaatcttggccaaaccccgtcctagtgtagagttttatcaaagttccattagcaggacttggggctttactggtaattttgagtgggacactctttgttgtactgatgcccagcacactgcaggatgtttagcaaccttggacctcccctccaccaccggaactaaaatactagtagcactcccagtccttgggttaaacaaaattctctacacatttccaaacaaaggcagtaaagatgctacccctggtggagaaccactgaagaactaagttagctcagagtaaggaaagaggaaatacagtctgtaaattctaaatgctatcaagatggatgataaatgtaattacttttaaagcacttttaaagagctaactaaaagactattcttcttcccctctggcacttagtcaaaaataaacatatttcttaataaaattaggctttgtaatgtatcaaggcttcatcgagttttcttaaaagttttttctaattcttgtaatcttaccgatttgttccatccagatttgatttgtggatgaaattaagttttgcatctgcccaataaagcttttgttcttcataatccaaagtcagtccatttggccagtaaatttcactgtttattataatgaagcgacttgaaccatccattccagcacgttctatctttggcacttctccccagtctgtccagtacatgaacctaaaaatcataaaaataattaaagccatgacagagcagatatcaatcaaatactctgtaattattactattaaagaaagctcaggccgcgcgcagtggctcacacttgtaatcccagcactctgggaggctgaggcaggcaaatgacgaagtcaagagatcgagaccatcctggccaacatggtaaaaacccatctccactaaaaatacaaaaattagctgggcatggtggtggtgtgtgcctgtagtcctggctactcaggaggctgaggcaggagaatcgcttgaacccgagaggcggaggttgcagtaagctgagattgtgctactgcactccagcctggcaacagagcaagtctctgtctcaaaaacaaacaaacaaacaaacaaaacaaaaaaacacctcattttagggacactaaaactcttagaaattgtattttgaaattctaatatctaccatttgcaactgccctggtaatacctgattcaaacaactatcatcaaggattcaaaaaccactgaatcaaaatgtattggtaaaaaggatatttacaccatttcaatgtatctccccacagattacttattaacaacaaagaagaaagtgataactttagagaaaataaacccagtggataccaccttaactgagtcatctaaattaacatcaccaataagggaacaaactggcattatatacctcttcatgtgatatacctttacagaacatagtgtcttttatacggtctctcttgcatattattcctgcccccaaaaaatgcataccccaaataaaattatgaggaaacagtgtgattcaagtcgagagacactacaaaacagttggtctttgacaatatcaatgtcataaaagtcaaaaaaaaaaaaaaaaaaaggaggggggggtcaggaaccaatctagactggaggagagcaaagagatatgataactacatcaagtgtatgatcttggactgatgaagtaggaagaaaaaaatgctatgatcactggggagaaaaggcaaaactgatgtagtgtcaaattgcatagtactgtactaatgttaatttcctaaatatgctaattgtattgtagttaggatacagaggggtttgctatactacttttgcttctattccacaagtttgaagacttttcaaaataaaaaatgagaagtctaaaagtctcattacagaaaaagaaatttttctttgatgtaaaagaaaaactctcttgggctgggcacggtggctcatgcctgtaatcccagcactttgggaggtcgaggcacctgtaatcccagcactttgggaggctgaggcaggcggatcacctgaggtcaggagttcaagaccagcctggccaacatggtgaaaccccatctctactaaaaatacaaaaaaaaaaaaaaagttagccaggagtggtggtgggtgcctgttatcccagctactcgggaggctgaggcaggagaatcgcttgaacctgggaggcggagggtgcagtgagccgagatcacaccattgcactctagcctggacaacaagactccgtctcaaaaaagaaaaaaagaaaaaaaaatagaaaaactctttaatgtattatacttctcttaaaagcatattttcaaaagttaatgaggagccaggagtggtggctcacacttgtaatcctagcactttgggaggccgaggtgggtggatcacttcaggtcaggagttcaagaccagcctgtccaacatggtgaaaccccatctctactaaaactacaaaaatcagtcaggtgcatgtaaccccagctactcaggaggctgaggcaagagaatcgcttgaatccaggaggcggatgttgcctcagtgagctgagattgtgtgccactgcactccagcctgggcaacagaataagactctgtctcaaacaaacaaaaaaaaaaaaaaaaaaaaaaaaaaagaggtaatgagggtgctatgaaacagatcaggcacttaataaatgtgttgaaacccaaatgaaattcaggtataagttttactcaaataatcggtggaatggtaatactgaaatgaatctacttaatgcatactgatgtctccactatttcatatgaactgcttactcaaagaaatgatgaggagaatatcatgtaggggaataaatacaccttctagatacaaggcactgtgctaatggcttcacatacattatcttacttaagccttaagcaaccctacaaaatattatttgttcatcaccacattttgatgagaaaactgagaaatgtaagcacatcactcaaagtcacattgctaataaatgaagaacagaaattcaaacctacatctcttaaattctgaagtctatgtgtatgtcatgggtcagagccttgatttttaaagaagagaaagcaaaatgctccctagattggggacaacagtcaaacactacccagaatgagcggtatggacaagattaatacaggataaaactgtggccatgagctgtgtaacaatgtggtcaacaacagactatgtataaaatggtggtcctataaaactacaatactgtattgtcactataccttttctatgtttagatacacaaatacttaccatggtgttatgactgccaccacattcagtatcgtagcatgctgtacaggttcgtagcctagcagcaataagctatcttatatagcccaggtgtatagcaggctgtaccatctaggtttgtgtaacacactatgttcacacaatgatgaaatcactcaacatttctcagaacatgtccctactgttaagcgacacatgactatatataggaaggtagaccagaccatgttacaatttttcattttggccaggtgcggtggctcacgcctgtaatcctagcactttgggaggccgaggcgggcagatcacgaggtcaggagattgagaccatcctggctaacacggtgaaaccctgtctctattaaaaatacaaaaaaattagccaggcgtggtggcagatgcctatagtcccagctactcgggaggctgaggcaggagaatggcgtgaacccgggacgcggagcttgcagtgagcggagatagcgccactgcattccagcctgggcaacagagcgagactccatctcaaaaaaaaaaaaaaaaaagaatttttcatttttattctgagaacaacacaaaggcactttaagacttttaaaattaaaggtgatggccaggtacggtgactcatgctgtaatcctagcactttggcaggccaaggcaggaggactgtctgagtccaggagttcaagaacagcctgagcaacacagcaagatgctgtctctattttttaaaatgaaaaaataataataaaataaaattggaggtgaaatgactggctttgtgttttcaggagggagaaaaaaatgcctgcggtttgggaaaaaactagaggaaaactaaaaaaaatcctgaggccaggtcttccaataggctctgtgagttcagcaaattctctcccttaagcaattaaaaaaaaaaacaaggtcaaatctaaccaccaaagcctccaaaaactgaccaaaggtcatacaacaaaatgagaagcatttattccagaaaaatacaccgcatctcaataagaactgtggtattttagctaggggctattcctatccccatctatactgccaggtttgtggcataaacattctactgtgggcaaacatggcaggccataaagagtggtagctacctttccctgcaagaggggactgaccttatttggaacgaggcatggaaaaatctgtacccaggaatgttgttaaaaacaagagtggactgggcgcagtggctcatgcctgtaatcccggcactttgggaggccaaggcagggagatcccaaggtcaagaggtcaagaccatcctggccaacatggtaaaaaccctgtctctattaaaaacacaaaaaattagctgggcatgatggtgtgcacctgtagtcccagctactcaggaggctgaggcaggggaggctgaggcaggggaatcgcctgaacctgggaggcagaggatgcagtgagccaagattgcaccaccgcacttttgagattccgtcaaaaaaataataataataatattaataataataacgctttcagtggcaggcatcacgagggccattatctaactgactctggtgggggcaagcaacaaaatagcaaactagccagaaatctaacaggaagatcctaggaaaaagactgccaagaagagccttaagtggatattcatgcttagtagtcaggaaggctgtctgcatgtgtaacgctacaccagaaagaacacttgcaagctagtctctggctgaacatgggtcaaatttgaaattgcctaaaattttaagacattctccaaaccataaacaggtccacaggaaaatggggtaacactaacttgctggtgttcaggaacaacctttaagcaatcattagctgaccactaagataacagtgacacagaggcaatcccccagaaagccaggcataagaaatattttaaaaggaaaacagaccacagaagtaatccaggaaagtcattaaacaaaaacacacaacaatggcaacaagcccagggagcggtcagaatccagaatccagtcaatataatatattcatacaatggaatactattcagcaacataaaagaactacttatcaatgtcaaggatgactttttaaaattatgttgaacaaaagaaaccacacataaaagagtacctactacgtgatcccattatatgaagctatagatgtaaaatcaaaaagactaatctatgatgataaaaccagattcacagttactggggaggagtaagggattgactgtaaaggggcttaaggcaccttctggagtagagtaatgaacgtttgtcttaggtgtatttatcaaagcccatttaacaatcaacaaaaaaatatgaattttttgcatgtaaattctaactcagtaaagttgcttaaaacgtgaataagaaacataaactatttcaagaagttaattcaaaggtaacttttcttagaaacctttcccagcttactaaggcaaagttattccctcttctgagctcttggcaggttttgttatatactatagtacttatcagagtttgtagataaactataaagaactcaaaggtaaagactaggtgtcactaccacatcacaatgactggcacattgcacgtattcttttttaaataaagatgaatccagaccttgtgctttccattttcaatttctcctctaacccccaactcagtgcacactgaaatgggtaaaggaagacacatgagatgctacaagaagagaaagaagtacaaaaggttaataacctaagcatagggacagccagaaacagtgaaatggttttgtgtgcctatgtctattataatatatgaactagatttctcctcaggatatctttaatacacaaatcaattgatatttccatcttgatagagtaatacagttaaaaacaagtccacagcacacttcattagccacctcccatcttttctctattaatgcataaaatgaaaactaccagtatctttaaacaaacaagtgtagagaaataagaagttactctcactgcaatatctactaatctatactctgcgccgtgtgtgcaacatgcattacttgagattacgtgatacaaagtttgaaatgttgccatcacaggctgggctgaccagaagcaatttgcacactataaagacagaaaatgcaataagggctattgtctttcttgtacaatataatttaggtaggtttcctaactgtaactaatctaagcatttaactttgtaactcagtgtctagtttatggtgaaataaaatgttacaaatgagtgagtcaacctaacaagattttagtaatgaataaaagtatttgcatgccactatgtaccaaagctaatggataatcccttcattattcaaccctaaaaaataaatcaagtcatgttttttcaaggataagacccagataaagattccaactacaataagtgaaactaaggcatttgtcagatgagaacttgacgaaaattagcatttttaaatagattacagatgtgccttcatttgtgcaaatatttaaaatataaaggaatagatttcatctataaatactaaacattttcattaacttttaaattaaaaagctcattacaaatgtaaccgaaaaagcgattaggacacagaaaatttttaaaaagtattttttaagttaccaatatattattcaattttcttaaggttttgaacacctattaaagcggtgagcacctattaggagctaagcaccatgcctgatacagggaatatgaaaataagcaaggcaaaactattgcccttacgaaattcgcaatgtagacaaggagtggcaagtatattgaggaaggtataaacaggaggctctgagagtatagagaagtgacacccaatcaagtcaatgaatgtaagagttgtcaataaaatataccagagaaagtatgtattttacttaggcagttgccaaaatgggaaatagtgttccaggaagaggacatagcatatgaagtcatgatatattcaataaacagcaagaagatccatagagctgtagcatatcgtgaggtacattgacaatgaaagaaatcccacgtgtattattttactatactaagaaacttggactccagtgacaataacattgagggactggctagaggaagaagaaacaagaaaaagccagaaaactgaaatattccaaataagaactaatgaaggcaacagaagttgaggactggatcaatatgaaagaggaatgagaaaggatagactaggatggctcccaagatttacaaatgtgaatgtgtgtgtattggtgtcattcaacataatatggaattagatgtggtttgggagagcaagatgatgagttcaaatatggatgaattgaagcatcctcacctcattgtttttccttctgtatccagaccaccagtcaatagaataacaggaaaatcagtgtaaaaataagtgaaagttggttagaaaaggtaaataaagtaaaaagcatattaacagtcaaagaagttggtctacagtaacagggcaaaataaatcacaattacgagttgcatatgaaactaagtcaatccagaagtgttgagccatgctaattctaagaacattaatgtgacacatgtaagtaactctgaaaggacctataaaaagccacaggtcctcaaaaacattttgttgccatcaaatttattttgggggaaacttcaaaaatcacatacatcattatcaaattgaaaatgcagccagtgaaaatagttctgattttaatgtgaaaaagaaaagtgttgtgtaaaattcacacccttcctgttactaacccctgaacttgattcctgaccccatgttcctctcttactccggttagtagattaggctttaagtgaagaggagtttgaagaatttacggatttctgcttcctaatagaagtgaaaagaaaaaaagaattgtgaagaaatcggacctacttctgcacttcccctctacttgatcatgtgttggtatcatattttaaaaacaagtagaaattaataaaagaggatagtgaaagcattcatgttagcaggttggtttctgtggttgtttttacagagaatatacagtaaccagataaaagagtctgggctgggtgcagtggttcacacctgtaatcccggcactttgggaggccaagatgggcggctaatgatgtcagcagtttgagaccagcccggccaacatggtgaaaccccaaaccccaacttgactaaaaatacaaaaattagttaggcgtggtggtgggcacctgtaatcacagctacttgggaggctgaggcaggagaatcacttgaacctgggaggtggaggttgcaatgagccgagatcgtgccactgcactccagtctgggtgacagagcaacactccgtctcaaaaaaagagagtctggaatggaattagatagacatggtttgggacggtaagatgatgagttcaaatacggacgaactgaagcatcctaacctcactgtttttccttccgtatccagagtagggatggctttgtcatcccatgtttttacctgtccctcaatagggataataattctacctaattacttgcttgtgacagtatgcatcatcatgaaattctgaatgtataaactggttgccctggagaaaataagaacctcatgaacagccttaagcacccagtctagtcgattacttttaaaaagttagtggacataatgcaaagaatatatttaattcagaaataacattggtaaaccactactagaagataaagattataacctgaaagcgggtaacagattacatcaatttaattcccaactatcatcaaagaaaatgctaactctagtaatttttcaaaattgctgttatacgtcattcctctttccaaagaatcaaaggtgatgcattttgagcgcctctaagtttaataaaaatgaaatattaactgtcaggaatgcccccttcaagcatactctcctctgtgctcctgcacgttattctgatactatgctccaggtacaaactacatctctgtacatttcaaatacagtattaggactgtttactcatatgttttcaccactctagattccaggtccttgaaaacaaggactttgttttattttttgttgtatcccctatcctaaaacaatctagcataatgccaagtacacagtcagcactcaaatatttaataatggtctgcactcacctgctcgtgagacctcttgtatctgtcttattaccaaggccgtatccttgaaaaatacaggtaaaattttattttaatgattacattattctactatgctccagttatgagctgcttttctttgaatgcacaaaagcatgaagagagcctgtcacataatatttctactgactaaaaattattacccacttccacaccttgtccctctagccaacaactgctcggctaacaagcaccaccctaaaatagtgcatccccaccgcccccctgccaagtaaaagtgaatactctgtcctttgtgtccccaccatacagatttccatagcaaaacttatagtttcactggtttattcatgattctatataatcagtctctttatatattttgcaactagtttgtctcagaaggtatactagaatatcctgtcactcaaatctggaagctatatatgcttcactgactttttcattaaatggtctcatagagagaattttattttttttaaggtaaatttatttcagtcatgctctatgagaacttcaactacctttctaataaatacatcaaaattagtttctgaggaaaattttgtccttgaccttgagaattcttggtcttgagaattagaacttatccagctcacctcacctgctttaactgaattgcactttgcccagatgccgcagggacaaatgccaaagaaatgtgtcactgtggatattataaagatattgttgaatatatttttcattatatcatatagcagcttctttagaggactaatgggaagaaactggtttcatcatctggagtaaatatttttttcagtgaacagcttttatctaaaggacattaactcatacctgatactttcttccctaaggaatctggcttaaaatcaaatgtgtgtggaagtatatgggaattaatgacatatgttttggtatgtatattttcactcctggtctcatcttacatgtatactcttatatttccatctcaattttaaaattttattttataaaattaatacatttatttattttgcatcacttttttatatcttcctaaaacatcttaaatccttttagagacaaagtaggaaaaacatttactatttttttcagtttagctattggggattaaacatttttcttattaatttgtatgcactttttatatatcaaggctaactctattattaatatatctgttacaaatatttttctttgtctttttttgcttgaatcaaaatttggttgaatcagtatttttctttgcaatttctttcattgctttcatgcttaaaaagcccttctctcttcaaagattaaacattcacgttttcatttgatgtttaagttttcacttaaaaatttttatccatctaaaatgtatctgaagtatgacatgagatactgatataaactgattttttctttcctaacggtaaattcttctagtatgacgtcccttccctcttgattcccactccttttatcacgttacaaattgtaacgtacagtattttcctaatctacttgtttaatatctattttttacaccaataatgtctcatagatttaacattagctctattaataccagtcttggataatcatgtgaccatagttttaattttcatctgcaaagtgaatacttcactagttgatgtaaggattaaagtaagacactttatataaaagaaaagtgtctttcctactggctttgacccttctgctctgatctggttgcaggacagttcttcatatttatcatcttctcttagacttttaccattacccaccccatggggtcttttagtcatctaaactccctgctaatacctattttataacagtaaccaaccaagaagccaagcagcaccccactctcaaaacacattttcaaaaatatgtcataagtaaaagaatatttattggatgcaggtatattacaagagaaaatttaggacaaaatagcatttactcaacaagaaaaaggaaattttcctttattctttaataaaacatctcagttaatatttacaagcactggatacaaatacttcctttatgttaaacctaacacccccttaccagtaaagataagcttccttttcataacaggtgaatacaatgtgccattcaaaggcccagtcagcttactaaaaacccattcttcagatatctcataaatcaactatgttatatagtaagaacctgaagtctttaatcatcataaacacattcctgcaaaataaatacataagcttaattcttaaaaggcaaaagcttaaaattcatgatctgatttgtaaaatatgctaagactaatcttttggttgcatttatttgaaatttctaagtcatgtgagaactttctttttcctttaactatcagagcctatttctgtaagcaagcatagaaaaaatagttttcctggttgggggaatatggaatgcgttttctccatttgaaaccaacccattagttccctagataggttttggataaacatagaagttgacccttctggtcttaaagcttgaatcttacatttgttttacctgagttccttcctcaggaaatgaccttcaggctgctcaaagtatcaaataactgaaactcaccagatcaccacattcagacagacaataagatgctagacaactcattcatcatgattgcttccttggcccgccttagttcctgtttcttttacatttcttccctgctatatgaacccttcgttttagtcactcagggagatggtttgagactgagttctcatcttcctggctgcagcacccatggcaatacttgttgtctcagtcactggctttctctgcagtgagcagcatgacctagaccaaacccctggtgttttggtaactcatttttatttgcagtttctgacatccttacaaataaacataaagttaacatttttacaaacacttcctaataaggaaaagtttgaggagggaaggacatcacagggaaataaatatcacaggttctcccactgatccctgagatttgaggggacagcaaactgtgcagaaataatgaaaaaaaataataaaaatagtctgataaaaacagtactgttgtttactattactaatggccttaatcagtaaggactaagattattttattttattttatttcattttgagacggagtttcactcttgttgcccaaactggagtgcaatagcgcgatctcggctcactgcaacctctgcctcccgagttcaaacaatcctcctgcctcagcctcacatgttggccaggctggtctcaaacttctgacctcaggtgatccgcccgcctcggcctcccaaagtgctgggattacaggcgtgagccaccgtgcctggccaaggactaagatttaagatttcagtagacagtgttttcaggtattaaagatcagagttttcttttaagaatctatttgtggccaggcgtggtggctcatgcctgtaatcccaacactttgggaagccaaggtgggaggatcacctgaggtcaggagttcgagaccagcctggctaacatggtgaaaccccgtctctactaaaaatacaaaaattagccaggcatggtggcgagcacctgtaatcccagctacttgggaagttgaagcaggagaatcacttgaacccacaaggcagaggttgcagtgagccaagatggggccactgcactctagcctgggcgacaagagggaaactgcctcaaaaaataataataataatgatctatttgtgtgatagactaatgtatctgcctaattgcttcatctttttcaaaatcttcaaagcggttatggtcttctatacctctcctctggtcctaattcgctgcaacagacttttacttcactttcttctgtcttaattaaatccacccacagacacacacaaacagggagaagacagaaagatttggagacccctctatctatcataagccaaaagctattagatttctgaatgtcctggatcttccagcacatttcaaagtgactttgttacccacaatggccataatgcaacattgttttataatgatttaaatttgaggttttaaaaaatgataataatatagccaattatactttttattcagctgaaaaatatgagggcctgaaaacaatgtaaatagtatttgagaagagaagacaaatccaagagctacttagaaggcagaataaacaagaattggtaactgattaaatgtgaggagtgaggaggtgggggcctagaatgactcaggatttttagtttctgcaaccgttaggtagaatgacagttgttcacaaattctgatattttgttatagggttttcttggatgtggtcttctctctgtacttaaaatttaaaaaaaaaaaaaaagaaaagaaaagctttgttaaaggttgttttctcaagccccaataaaactaacggataatccaaacagcctctttccagacttcccatcccctacccttaaggccattttccagaatactctgaaattaatgattatattaccaccacatcccctcccacacaccctccccctccctccccctgcccctgcaatctgggattatgtaatttccttactttcagcatgaatcccaaacttcttagcatgacatataagagcctttctaatttgtttctctgcttttggttcctcatttctcacggctctagtatcctgcctattgctaccagactgcctttcataaaatacagtatcatgtaaacacaaatcctttataactggggtccccaacctccaagccagagaccactaccagttcatggccttttaggaaccaggtcacacagcaggaggtgagcaacaggcaagtgagcaaagcttcatctgtatttatagccgctccctatcgttcatattactgcctgagctccgcctctgtcagatcagtggaggtattagattctcataagagcataaaccctattgtgaactgcgcattgcaagggatctaggttgcgtgctccttattagaatctaatgccttatgatctgtcactgtttcccatcacccctagataagaccatctagttgcaggaaaaaaactcagggctcctactgattctacattatggtgagttatataattatttcattatacatcacaatgtaataataatagaaataaggtacacaataaaggtaatgtgcttaagtcatactgaaaccatccctccagcccagtccgtggaaaaactgtcttccacaaaaccagtccctggtgccaaaaaggtaagggaccactgctttacgagacactcttagctttaaaagctatagggactcagatttccctattgctaaacatactacaaagccacagtaatcaagacagtgtgatactagcataaggacagacatctagataaatttaaaagaaatgaaaatccaaaaataaacccttatatttatggtcgattgactttcaatgaggatgtgaagacagttcagtggggaaaaacagtctgttcaacaaatagtgctgggataactggatatccacatgcaaaacaatgaagctggacctctaaaggacatacagaaattaattcaaaaacgataaagacctgattgtaaaagctaagaccataaaactcttagaagacaatgagtaaatattcatgatccagaattaaaagaatggtttcacagatataacactaaaaccacaagcaacaaaagaaaaaaacagatcagacttcatcccaaaactccattatatgtgtgtttcaaaagataccacaaagaaagtgaaaaggcaacccacagaacaggaaatcagtatttgcaaatcgtatgtccgacaaaggtctggtttccagaatatataaagagctcttagaactcaataataaaaggacttaccaggcatagtggttcatacctatagtcccagcgactggggaggccaaagtgggaggaccacttgagtccaggagttcaagaccagcctgggcaacataacgagaacccccatctttaccaaaaaaatttaaaaatttgcctggtgtggtgtcacccacctatggtcccagctactcaggaggctaaaatgggagaatcgcttgagcccagggagttgaggctgcaatgagccatgatcatgccactacattccaggctggggaacagaccaagaccctctctcaataataataataataataataataataataataataataatactatacaattttaaaataggtatttcacaaatcaagatttacaagtggtcaaagcacagaacatgttcaacatcagtcagtaaggaaatgtaaatcaaaacctcaataagacatgcctatacacccactaggatggttataactttttaaaaaaggagagagggccaggcacagaggctcacacctgtaatcccagctacaaagaaggctgagaagggaggatcacttcagcccaggtgtttgaggctgcagtaagctatgaccatgccactgtactccaacccaagtgacagagcaatacccccatctctttaaaaaacaaaaaaccaggaagagacaaagaatagcaaatattgcaggaaagagagaaactgaaaccctcatacactgctagtggaaatataaaaatggtagagcaagtttaaaaaacaatgtggggctgggtgtggttgctcacgcctgtaatcccagcactttgggaggccgaggcgggtgatcacctgaggtcaggagtttgagaccagcctggccgacatggtgaaatcgcaccgagatctcaccactgcactccagtctgagcaacacagcaaggctccatctcaaatacaataaaataacaacagattacttgtagggcccactttagttacaaattttatactcttaactgtctacccctttttggtttttgtttgtttgttttttgagacagtctcactctgtcgcccaggctggagtgcagtggcaccgtctcggctcactgcaacctccaccacccggggttcaaacgattctcctgcctcagcctcccaagtagctgggactataggtgcccgccaccacgcctggctaatttttgtatttttagtagagatgaggtttcccatgttggccaggatggtatcggtctcttgaccttgtgatccgcccacctcagcctcccaaagtgctgggattacaggcgtgagccaccccaacaggccaactgtcctccgcttttgtatctaccattgcacctcattcatttttcaacattagaaagggggaaaaaatacaaacaagactcaaatcacagcaaagatatccacaaatcctgtaaccattccctttcattcacaaaatgttctttcatggatatatggcactggagggggctacccagctttatcgaatccactttcctatgtttggagaattcttcactttataaggcagaaccttgccctaaaactaaagaaactgaaaaccaggtatttgctttccacatctctctcctaactgggacagggttacgtgtaagtcctgagcttttccagtcagacaaaccaaccccgactttgaaaaactgaatcaacaaaaggaggaggacgtagaggtcaaagaggaagcagcgacagaagcaagccccataagcaatccattctggtgaggttgaaggcaacagcaacagctaatttactccagtttgaattaattaatccttccagctgggcacggtggttcacgcctgtaatcccaccactttaggaggctgaggcgggcggatcacctgaggtcaggaattaagagaccagacaggccaacatggtaaaaccctgtctctactaaaaatgcaaaaattaaccaggtgtggtggcacacgcctgcagtcccagctactagggagactgaggcaggaggatcacttgaacccaggaagcagaggttgcagtgagctgagatcatgccactacattccagcctgggcaacagagcgagaacctgcctcaaaaaaaaaaaaaaaattcttccttcatccagttttaaaagggaacactgacaacagttttaggagtatctgtcaccttatgtcagagaaagtacaaatagtgtgaacatgtcacctaacagtgatgctttcactggaccagctctgcagtatagtacgtagcacactgttcctgcacaagactggttcttctaccctttaggaaattctatgaatagcccaatatcctctttaatcacaaagccatttatgattaaagtagagggatttctattatttaagactatgaacactaacgcatatttttcttagtttttttttttttttttgagacagggtctcactccatcacccaggttggaatgcggtggtacaatctcagctcactgcaacctccacctcctgggctcaagcgatcctctcacctcagcctcctgagtaaatgggagcataggagtgcgccaccacacccggttaattttttctatttttaggagacacagggtttcaccacattgcccaggctggtctcaaactcctgagctaaagtgatccgcccacctcagtctccgaaagtgctgggattacaggcatgagccaccacgcccagcctaacacatattcttagatcacaacggcatcccaaagcatcactttaaagttcagataaagtaacttcaacccttgctctgacaaagtttcgtatcttacaactccctaccttctacaagtggcatgtttgcagtctcagttcttcccacaatctactatgacccctctctccttaagaaccaatgtcaatattcgtgagactggttagcagaaaactgtcagctaaatcacatcctgacccttctttctgtacacacatttaaaacaacatcttgatgcaaactgatataaaaggaacaatttattacagatgcaaaagccaacttaacattaaacttttgtatttatatcaccataaacaatgaagtgtaagagaaaacccaattgaacagtttggttcacccatgccttcataacttcaaaacccaataatcatcaatacataatgatgacaagataaccagttcttgaatattaagaaactagaattgttgctttagcatgtttaagactatgcacctcccccctcttccctctctgacacacacacacaaaataacagcatcaacagcatcagcaacatcatgaaatacctacaacaaaaaatttcaaccctggcagcacttgagaatgacctaagaaatttattttaaaatatccattatgtgggttctttcatcagagattctgattcaattggtctgggctcgaactcaggaatcaatatttttttaacagcttcccaaggaattctaatgcactcacacagggcttagaaccagtgaagaggaacataatgttctcaagcacctgtttatccatagcattctattcttgcacagctggtgttaatgtatttaactcattaaccactgaccctaaatattagctaatcattaagccccagttggtactcgcctgtgtggaggttaccacatagtctgggaggatgacttaaaatattttattttggtgttggactgtgtcatctataattctggcttcagagaacagagtaaaatatgattgagatttaattggtggtttttctgaattgatctaggagtgatctgctaaatgctttatgtacttatacccttccactgtgcaagaccatataggggaacaaagtaacaactaaaattccttctcacacaatgggtttccacatttccttcaaaagctctacaaattgggaagggggatttgaaaagttcacaagtactgcttaaattttactaagcagtaaattttactaagtaaaaatacacacatctgtgagaataaaagtagattttcaaatttccactataacctttcaagcttttggcacccaattttatatatttatagcgataatcctctatatataaagaaagatcacggccgggtgcagtggctcacacctgtaatcccagcactttgggaggtcgaggcgggcggatcacctgaggtcaggagttcaagaccagactgaccaacatggtgaaacctcatctctactaaaaatacaaaaaaattagccggtcgtcgtggtggtgcctgtaatcccacctactcggtaggctgaggcaggagaatcgcttgaatccaggaggcggaggttgcagtgagccaagatcgcgccattgcactccagcctgggcgagaaagcaagactccgtctcaaaaaaaaaaaagaaagaaagaaagaaagaaagattccattcttgcgggggaaatattccaagacccgcggtggatgcctgaaactgcagagtaccaaaccctatatatactatgttttttcctatatatacatacttatgacaaaagtgtggtccatgaaccaatcaagctccatcctacatctacagaatcagaatctgcactgtaataagagaataaaaccaaaatactatctttccttacattagtctttataacatcagaaaatacatagtaaatgtatagtaataaaagttacatatacaatcctaaaaataacactaacgaatatttctaggataagtatataaagcatttagcaaatcactcctagaccaattcagaaaaaccaccaattaaatctcaattatattttactctattctctgaagccaaaattatagatgacacagtccaacaccaaaataaaatattttaaatcatcctcccagactatgtggtaacctccacacaggccattagttaagaatagtaacaattataaagatgttccaaggattttaagaaatacctccctaattatttcactcaagttcttcatttcatcagaaaaaaaaaaaaaaaaaaaccaggacctaagacctgaattttcccaaaccttttagatgcatgtgatggtcatttatctgagcctcccagaatgactgggaaatgaacatcctacaagtcttgccacaaaccaagtgtttaacagaaaattaggcacaagtattagctacactgaaaccttgttgctgtgtttccccttgggaatgatggctaaggtagaaccataccgcacatatttaaacaataatttacataaaattacaaatactgtaaaatacaaccactactcttatgatgaaggaatctgcacttgtttatatcaatacaatctttcatcttgagggtcattcaacaatatgactggtaatacataggtatgggcctaacaccctcccccagtctgtgagatctgacaaatcctacagtattttttaaatcaaatgctaaaaatattaattatacttttctactactcctatcttaatttttaatgggtataaattccaaggctgagattatttttcattgttttaaggttaatcaactaaccttatttaaagtgtacactgtatatagtaagctaaacatggactaaacgctgatgtctccaattctaatcctttaccacatggatcactctagcctccttctccttgcttgtaactttccattccaacagtgagaaatctggctaccacaatccaccatccacttatacttaactgtttagtatacattactagaggtatcagaattgcagtatcagaattgttaactatacctttatatgaagcaatattatcaaccaatgtacactacaagtaaagaatatgtgcagtgccttttgcctttagtattacaggcactatgcatctccaaaattaattagatcaacagttttcccccatcacccacttcaatgaggttgttttatacatctctaatacaattagattcttctgtctcaatctgcattccatcctggaatcccccagcctcctaaaagatggtcttttaaaattcgtattcattaaggtccacgctttctgctataaagtgctatgggttttgacatctgtgtagtatgcttttttcctgtttctcatcttctacatatataacatcttacaaacaattttaccaccattcttcaaacaaacatacatacttccacagtcatcttcaattctactaaacagtacagtctacatgcttgcaggcttatctccatgcacataccacctttttttttttcccacaatctctaggagactcatttcagaaaacttcactttcaagattactaacagttgtctgctcatgattaggcttcaaaagaaaaatgttaaatttatttatatagaaaacagatttcatatccttattttacaaccgagttctctaacacttatgtgtctatcaaaaataaattaatgaaagcttgaaaacagttatgaattcattatactgctttcacatccacttcaaacttcctatatataaactgatataacatgggttcacttacccagctcagtctcactataaggatttttaaacaaaatcagtccagtccactgaacagtatcagcttactgcaggtacattgtctttcataataaataacagtatcagtaatgcaataccaacacacagggaactagactaagaccaaggatataaataaggtaagaacatacctattccctggatgcctgcctgaatccaaattaaaaccttctgaatggccaggggcggtggctcacacctgtaatcccagcactttaggaggcccaggcaggcggatcacctgaggtcgggagttctagaccagcctgaccaacatggttaaaccccatctctactaaaaatacaaaaattagccggttgtggtggcaggcacctgtaatcccagctacttgggaggctgaggcaggcgaatcgcttgaacccagtgggtggaggatgggaggatgcagtgagccaaaatcacgccactgcactccagcctgggcgacaaagcgagactccacctggccggggtggacgcagtggggaagaagcttggaaatcgttactctatcctaatagtgagtaaaaagctaaacaacaacaacaacaaagatcaacaactcttcttagatccaccagagaagtaaggtcacagggcaaaccactgcccccacaattggatagacagacaaggtgataacaaaggatcataatttatcaaagcagaaatccacagacaaaaacctctctacaggagccagcacccgagtaggaaaacctaaattgcgattgatgacttgctggaggcttagtatagacaaatctgaaagttaaaaactctagggacactttttttggttttacctccaggagctctaccaggttctcacagtaaagatccaagccagtgtggtggctcactcctgtaatcccagcactttgagaggccgaggcaggtggatcacttgaggtcaggagtttgagaccagctggaccaacatagtaaaaccccatcgctactaaaaatacaaaaattagctgggcatggtggaggacacctgtaatcccagctactcaggaggcagaagcaggagaatcgcttgaacccgggaggcagaggttgcactgagccgagatcacaccattgcactctaacctaggcgacagagaaagactgtgtctcaaaaaaaaaaaaaaagagagagacctgagaaaaatacccactgctgcctgtgcaaggagagttcttgtaaagctatagtactggtaaggtctgccctcaagaaaatccatcttactacagcctaaccaacctgggggaaggaaaatatccagctccacctccctctccccgtctacacagaagaagagaaatacttaactccagcctcctctaaccattctgtcccacctaaggggatgaaaagaactgagaagcacttgtgaagctcacagcccagggcaatggctgactaaacaactgaaatatagtcattgaactatagactattttttctctccccacagcttaccatcacattacaaaaggcctatatatcacaattccttttatctgatatatcatatccagctttcaacaaaaaattacaaggcatactaaaagacaaaaaagcagtttgaagagacagagcaagtaccataaccagattgaaatatggcaagaatattgcaataaacagacaagaatttaaagcaactatgattcatatgctaaggatgctaacgggaaaaaacagacaacatggaagaatagactgataatgtaagcaaggggaaaaatcaaagagaaatgctggagaccaaaaacactataacataaatgaagaatgcctttgatgggtttattagtatactgttcatggttgaggaatctgagcttgggaatatgtcaatagaaacttccaaagctgaaaagcagattttttaaaaagactgaaaaaaagggaacagaatatctaagaactgcgttcagttcagcagcacatatactaacactggaacaattcacagatcagcatggcccctgcacaaggatgacatgcaaattcgtgaagcgttagtatttttataatatatatttttaaaaacaataagaactgtgggacaattattatacaaaaggtacaacatacacataatgagaatacagaaagagaaaatatttgaagccgtaatgacagaattccacacaaactaatgtcagacagcaaaccacagatccagtcagctcagagaacaagcgggaaaaggcaaaacaaaaccaaccaccacctaacaccttggcatatcatattcaaactgcagaaaatgaaaaaaataaataaatcttaagcaagaaaaaacaccttacttgtagaagagcaggattacatccaacttatcctcataaaccatacaagcaaatagagaatagagcgaaatattttaaaattcaagagaaaggaaaaacaaagaaaaaactgctagcctggaattctctaccctgcaaaattatccttaaaaagtgaaggagaactaaagactttctcaagaccaacaaaaattgagggatttgttaccagtagacctgcgttttaagaaatgttaaaagtagttcttcagaaggaagaaaaataatataggtcaaaaatagatctacaaaaagaaagtaacggcattagagaaggaataagtgaaggtaaaataaaaactttcttttcctttttttttttttttgacacagagttttactcttgttgcccaggctggggtgcaacagcgcaatctcgcctcactgcaacctccacctcccaggttcaagcgattttcctgcctcagtctcccgagtagctgggattacaggcacgcaccaccatgccaggctaattttttgtatttttggtagagacggggtttcaccatgttggccaggctggtctcgaactcctgacctcaggtgagccacccgccttggcctcccaaagtgctgagattacagacttaagtcaccacacctggccttttcttattcttaattgagctaacaggtaacagtttgttcaaaatagtaacagcacagtgtagtcaatgattttagcttatatataagtgaaatgaatgatggcaacaatacaggggatggaagggagaaattaggagtattttgtttcagccaattctgttgtaagtccaaaactgttctaaaaaatggtcttttatttaaaaaacaaacaaaaggcaagaggggagccctttctgcttcagtttgctgttctgtaaagcttggcactcatttttagtggtcagtggtcaataagactggtaccaaatcctcatttggcacatttccccgagagtagctaaattatgtatccaaggtaaggattaagaaagagagcctggccaggtgcagtggctcacacctgtaatcccagccatttgggaggccaaggcagggggatcacctgaggtcgggagctcaggaccagcctggccaacatggtgaaacccccgtttctactaaaaatacaaaaattagctgatgcacgcctgtagtcccagctactggggaggctggaggcatgataatcgcttgaacccgggaggcggaggttgcggtgagcccagatcacaccactgcacaacagcctaggtgacacagcgaggctccatctcaaaaaaaaaagaaagagaacctaacaggaagagataaatgctatgcctaaaaggtaacaagtagatgtcttcagtttatgcagtgacccagcagcagaatgagtctttagtctcaggatctgctttatgagactgtgcccttctctagtgcaggggtcctcaagccccaggctgtggaccagtagcagtcagtggcctgctaggaactggccgcacagcaggtgagcagcaggcaagcgagcattactgcctgagctctgcctcctgtcacatcagtggcagcattagtctcaggagtgcgaaccttattgtgaacagcgcatgcaacagatctaggttgcacacctccatttgtgcatctaatgcctgatctgaggtggcacagtttcatccagaaaccatcccacccaccccgctactgcccagtgcctgtggaaaaactgtcttccacagaaccagtccctggtgccaaaaagtttagggaccactgctctagggaaagcagaaaatggcaataggccccagcgagctaggaaagaggcattcattgcattcaaggatgcagcactgaagctaacccaagaggagtggtagctactgaggcctgctcagaggacatggtacagggatgtgatgcaggaaaagtcctgagggaaaaaaacattctcaagatctgctaggatatgacacaaacattttctattatgaggaaaatgaagaatatcggcccggcacaacggttcacacctgtaatcccagcactttgggaggccaaggcaggtggatcacctgaggttgggagttcgagaccagcctgaccaacatggagaatccccatctctactaaaaacacaaaattagcctggcatggtggcacatgcctgtaatcccagctacttgggaggctgaggcaggagaatcgcttgaacccgcaaggcggaggttgctgtgagccgagatcatgccattgcactccagcctgggcaaaagaagtgaaactccatttcaaaaaaaaaaaaaaaaagaagaagaagaagaatatctcacactgagacttgaaaatctctcccttaactcagccatttaaaaattaaactgtgacataaactccttgactacttcattttattttagactctttcaaaaaataaataataattggtgtgcaaatattaaggagcaggtttggttgttttgtttttgtatttaatctaccttagaatctaccttagaaacctgtagacacataaaagcacttaacaatgaagttgcttaattcaactagttgtgtaatatattctgcaagggcttttatcagcaacatattttaaagccaattttagtatgctttgggaaacagaaagtgtgtgataaatatctcccttggcttctcaaaagctaggctacaggcttatatagaagaaatctcacttcagcagtaatctttactaactctggttatgtaatctatttggcctctaatttattttggcctcaattagctttattttggctttgaattaagagagaatgaacatatgtacttgataatgattaaataaatatatgtggtcacagctccactttgcaatagtatacacatctgctattcatccaaaaatcatgaaaaccaggaccaggctgttatatgctgttcattagcgtccacacaaatgtaattttattgctgtgtctggtctcatattcatttgtaatgctttctggaaaataatttttaaatggagtgaaaggtagaagatgagcttcattttaactgggagggaagtaaagcaagtaaacatatattaagttttcaagatgtcacaatttcttatgccaggaaaataaaaatatctcaaactgataataagactagacacacaagccattttatacaaatttactttatacatttttattacaatccaaagcatttaatttatttgattaggtaaggataaaacaacaaatcttccaaaatattcacaagccctaatttggtaagtatactcaatctgaattcggcttcccataatgaaaatgttcagtttcaataaatctagactaaagggatgaaatttcaccctttacaagatgtaattacatacacaggtgactaattaagacattgagacttgagctataaaaactaagtgacccagatctatactagatcataaatcatgtcatgatccttgaagttacttatataatcctatccataattaaaataagtcattaatatacatattagcaagtatgaataatcctcaactatcatgcacatggtacatgaaagaatagacaatattttaaaacatgtaagtcagagtttctattctggtaatatggtaaaaagacaaccagaaaatacttcttttacaaaacatctagaactactggtgaatctttttatttgatttgtacatatacacaaaataaaatatacaaacacccctttaaatgtagaacttatcaagaaagtaggagaaatctcctgagaccaaaaatgaacaggaaagtaaaaagcagtacatggccaggcgcagtggctcacgcctgtaatcccagcactttgggaagccaaggtgggcagatcacaaggtcaggagttcgcgaccagcctggccaatatggtaaaaccccgtctctactaaaaatacaaaaattagccgggtgtgatggcaggcgcctgtaatcccagctacttgggaggctgaggcaggagaatggcttgaacctgggtggcggaggttgcagcaagccgagatcgtgacactacactctagcctggatgacagagcaagactccatctcaaaaaaaaaaaaaaaaaaaaaaaaaaaagcagtacatgtttgacctgatgctatgacgaccctggattttctgatttcagaaactgagaaacttctgttccaatgacaagccagagaagatcttggcacacaagacacagtgttagaagtaagattcctgcacaaagcatggactctcaaagaacaatgaagtagaaagatctgcccactggcagagggacacaggaagccttttttgtcttgccctaggctctgaaaaggtaggaaagatcaccaaagatttcataatcataagactgcccctacataggtttagagtttgatttattctatccacatagtacagaaactcccaacttcaaaaattaaatataaaaaatgacttctgcttgaataaggcaatgataacatttgataactcatttaccaaaactcaaactaagccgggcacagtggctcatgcctgtagtcccagaagtttttagatcagcccaggaaacggttttttttttgttttgtttttgtttaaacaacaacaaaaaaaactcatgctgagcagcgcagtggctcatgcctgtaagcccaacactttgggaggctgagatgggcagatcacttgagcccaggaattcaagtccatcctgagcaacatggtgaaaccccatctctacaaaagatatgaaaattagccggatgtggtggcacacacctacagtcctagctacttaggaggctaagatgggaggattgcttgagcttgggaggcaaaggttgcagtgagctgagactgcgccactgacgaagcgagaccctgcctcaaaaaaaaaaacaaaaacaaaaacaaaaacaaaactcaaacttcacacttgagatctgtgcaatttactgtatataaattatactttaaatagttaagtggtcggctgggcacggtggctcacgactgtaatcccagcactttaggagaccaaggtgggcagatcacgaggtcaggagatcaagaccatcctggctaacatggtgaaaccctgtctctactaaaaaatacaaaaaattagccgggcatggtggcgggtgcctgtagtcccaggttattgggaggctgaggcagaagagtgtcgagaacccaggaggcagagcctgcagtgagccgagatcgtaccactgcactccagcctgggcgacagagtgagacgctgtctcaaaaaaaaaaaaaaaaatttaagtggtcactggaaacacttccagtgaacttggcaaaagcaacccaaaatctctctggaggaatatgcccccaagtcattcagaattctcaaggacagcctctctgaagatctgttcacagtccaaaactatataaaacactcgaggaaacatttaaccttaagcaagaatccagcaggtgcaaaaaaaaaaaaaaacagaagtagatttttaagaacttcagaaaactgaacaacttgatagagattataaatatttaaatgatgaaaacacataaaagatggaataaaatatatgacacaagaaaagacatcatcaaacaataacatatctctaataagaaaatacaagaagcaatcctcagtgcatgctaaaataatcaatagatgagtggttaataaggaactaggtatttggcaaaatacaaaaggatcatcccacaaataacttaaggacacaagaggaaagggctcaacttacaaataaagatagtaactttcaggcactagagtcaaaaaccaaatattataacaaaagatgcacctaacatcccaactgctcagaaaatctgaccatctgaacctactgaataatcttagcaacactacaatataggacaacttctgatgtgacaaatacaaagtactcagtactacctatgaggcattcatgtcaaaatgttaaatctgtctctaatcaagtcttcaaatctttctttccaagtaacacagggggataaaaataagtcaaataccacaataatttgttagaaaaaaaaattgtctgggcgcggtggctcatgcttgtaatcccagcactttgggaagccaaggtgggtggatcacaaggtcaggagatcgagaccatcctggctaatgcgctgaaaccccgcctctactaaaaatacaaaaaaattagccgggcatggtggtgggtgcttatagtcccagctactcaagaggctgagacaggagaatggcgtgaacccgggaggcggaggttgcagtgagccaagatcatgccactgcactccagcctgggcaacagagtcagactccatctcaaaaaaataaatgaatgaatgaatgaaaataaaaaatctgggatattctataggacagctgacccagtcttttcaattaagtcaacaaggtgagagataaaaagggaaagggggaggaccaactgaactgctctagaaaaaccacatacaacttgtaaaccaaatgtttggactctgatttcaaacaaccaactataaagcaacatttctgagacacagatatctgagtatgaacagactaatttataacattaaagaattgttcatcgcaagttgtgtgaaagacagtggcattatgattctagaaaaaatattttttagagatggaaaataaagtatttacaagtgagatatcgatgtgtgaatctgctttaaaatatctcagctaattaaaaaaaaaaccagcctaaaagcctacacatagagagtagttgaataaactatggtacactcacacaatggtatactatgcactggcaaaaaacaatgaggaagatctctatgaaatgatatggaatgacattcaaaatgttaagttttggccgggcacggtggctcatgcctgtaattccggcactttgggaggccgaggcaggcggatcacaaggtcaggagtttgagaccagcctgaccaacatggagaaactccgtctctactaaaaatacaaaattagccagacgtggtggtgaatgcatgtagtcccagctactcgggaggctgaggaaggagaattgctttaacccaggaggcggaggttgccgtgagccaagatcgcaccattacactttagcgtgggcaacaagagcgaaactccatctcaaaaaaaaaaaaattagcaaggcatgatggcacatgcctgtagtcccagctacttgagaggctgaggccaaagaatcacttggacccggaaggcggaggttgcagtgagcccagatcgtgccactacactccagcctgggcgacagagtgagactccgtctcaaaaaaaaaaagttaagtttaaaaagaacatgcaaaagagcatctactgtatgttactctttcatgtaagaaaagaagattataagaatatacacattcacggctgggcacagtggctcatgcctgtaattccagcactctgagaggctgaggtgggtgaatcacgaggtcaggagtttgagaccagcctgaccaacatggtgaaaccccgcctctactaaaaatacaaaaattagccgggtgtggtggcgcacatctgttaatccagctactcaggaggctgaggcaggagaatcgcttgaacccaggatgcagaggttgcaatgagccaagatggtgccactgcactctgggcgacagagagagactacgtctcaaaaaaaaaaagaatatacacattcacattctgagaacggagatataataaaagaaaaaaaaagaatatacacacgtatcaactcatttgtacataaacaaattcacaagaaaaaagcagaaattattaagactaagatacctatagagaagggtggggaaagactggaaaaaagggggtaggagatgggactaggatagaagggatggggaagaagaacactttcctgagtataaatttttgtattattttttactgttaggaacatgtcaattgtttcacataacaccaaagtaaattcgtttctcacaatggtggtataggctaatgattttaaaactcccttaatgtgtacactaagatgggcaaataagaaaatctatcatgataatgagagccaggtttctcactatcacagaatagaagtaaatatcccaagtaagaaaagggagaagactacaatgataattttgtggtagtagactggaattggcgataacatgaatttgtttttacgtatagcaaagacacagaactaggggtatgtgtgtctacatacatcatatatttcctaactctgtccactgagaggtactaaactaaatacaataaaagaaaatacagccgggagcagtggctcacgcctgtaatctcacgcactttgggaggccaaagcaggcggatcacctgaggttgggagttcgagaccagcctgaccaacatgcagaaaccccgtctctactaaaaaaacaaaattagccaggcatagtggcgcatgcctgtaatcccagctactcgggaggctgaagcaggagaatcacttgaacccgggaggtggaggttgcagtgagccgagatcgcgccattgcactccagcctgggcaacaaggacaaaactccggctcaaaaaaaaaaagaaaaagaaaaaagaaaatccagtagcaaagagcatacctagtttccacatcttcatttctaaataccattctctaataaaaggagccagaactccttggagaaatagttgattcaaggagtggaacagaaaaaggacacaatgagtctggactgcctggagtcgccagaaagtaaataagtacttaaaaaacaatgagggcggctggacgcggtggctcacgcctgtaatcccagcactttgggaggccgaggcgggcggatcaccaggtcaggagatcgagaccatccgggctaacaggtgtgaaaccccgtctctactgaaaaatgcaaagaattagccaggcgtggtggcgggtgcctgtagtcccagtcactcgggaggctgaggcaggagaatggcgtgaacccaggaggcggagcttgcagtgagccaagatggcgccactgcactccagcctgggcgacagagcaaaactccgtctcaaaataaataaataaataaataaacaaacaaacaatgagggcatgtacaaatgactcaggaaccaacttgaaagagctcccagtggtcaaatctgcaacaatttgagcaagaaaatcatgacagttttggattacaacctacaggataaaataaatgcccatgaatccatactaattgtatcagaaaaacacatttccttctctcacagggtcaacataacagaacatttctgacaccagatcgctgggcggggtgacgggggggttccccacaccaagcaattctacaacaccagctgggtgtcctacaagccagttcaattctgacactatctatgtgaagacagcatcagatcccagtaacgggctcggtcctaaaagactgcctccaacactgcaggcacccgtgcttctgactggccagctataaactggatgttcccacaatcccctcctcaggttcaatcatttgctaaagtagctcacagaactccgggaaacactttatttatatttatcagtttattataaaggatattacaaaggatacagatgaacaaccacatggaaaagatacatagggagagatccagaagggtcacgagcacaggtgattccatcctaatgaaacatgaaaatggatgtgttcaccaacccagaagctctccaaacccccataattcagggattttttttttgaggctttttatataggtatgactgattattagctctatctccagtccctctcccctgcccaaggatgtgaagtggagctgaaagttccaagcttctaatcatggcttggtctttctggtgaccagcccccatccagaagcctatcaagagttgcctcattagaacaaaagatgttcctatcacccaggaaattccaagggattaggagttccatgtcaggcactggaatcaaagaccaaatattagaacaaaagatgcacctagcaaccctactgctcaggaaattacaagggttttagaagctctgtgccaagaaccaggggactgagaccaaatatattttcacaatatcacactaatataaataactgaataaataaatgagagagacaggacagctctacgttaaggtagaaagctaataatgcacacagaaggaataatggaactagaaaaatcgctatttggcaaacagcaaacatcacagtaataattaacacaggcaaaaaccatcaaggaatgctaaaatttgtggataaaagtatgatgagaaacaggataattgcacagcctcaaatatatattgcaagggaaaaaacagtaactacagtgaaaaaaaaactagcagacaaaaccatagccaagtgatcaactgtaacatcacctagtatccacataatgtgcctgctgacaggatgccctgagaagggcataataccacttctgtggtattcttgccaaaaatgtataactttaatcaaatcatgagaaacagcaaatagagccaaactgaggaacgttctacaaatgactggccaataatcttcaaaaatgtccaggttatgaacaacaaagaaagactaccaaaacatctcagattagaaaaggccgaggagataactaaatgcaaaatggtatcctggaccagagaaaggactaatggggaaaacggagaaattcaaatatggtctacagattagttaacagtattctatcaacattaattcctggttagataactgttctatggttatacaaaatgtcaatatttagggaagctgggtgaaagttacactagagctatgtacaatttttgcaactttttttccaagtctaaaattactgatatactgttttctctacttttatgtagctgaaatttcttcataagggggcacaaggaacttctaaaaaaattaaaatatagtcactgatattaaaacctcaattaacatgttaaactgcaaagttaggcacagctgaagaaagaattttgtatctagatggcaggtacaaaagaaaaaaaaaaacagaaagtggctcagagaaataatgagagagaagataaaagagcaaaattaagaggaaaggaacagggaattagaaaggaacacatatcaaacaagagttccaaaggagactaaggagaacgaaggaaaattaagaaaaaaaaggataagaattctctagaattaacaaacgacaaaaatgcttagattctagaaatatgaatcctaaccaggataaataaaaatatatccacatctagacacagggtagacaaagctgcaaaataccaaaaatcaagagaagcttttaaaaaccacaaaaatattaaaaaagataaatgataaattacaatgcaatacagacttaatcgtaccaacaattaaagccatacaccctcaaaggtctgagtgaaaataactaatcacgtagaattctatactcaactaattatcatttcaagaatgagggcaaaataaatacatttttagacaaagaccaagagttactattaacagacgcttattgaaagaaacactgaagggcatacttcaaacaaaaggaagctgaatccaaatggattaactgggatgcaaaaagcaatggtaaaataagaaattgctacactgagtaaacctaaaaacatgaaacttattttaaaaggtcctttaaacaaagctaccatgttcaattttttaaagtaattcaactcgtaaaaaaaacacaaaaaacaaaaaacaatggcttcagtaagatacctttcacaaagaaaaaaagcaccaaacacggaattcaaaaatttcaactaagaatatagctccctctcatttatcttggtcaaaggccttggtttcttcacccaaagaagggaaggaaggcatttagctagaggatccttaagattcccttccagttctaggattcaagggatagaaaacagaccttcccaatttaacagaacatccttcaaaactgtaagttgtttacaccaagatccttcatacacagggacagtgctttaaagcaagatccagtctaaagctttagattttaaataattggctatctgcttctatgcaaaagccaactggaaacggatatgatctcagaaaaagaacaaagaaaataatgcacttttaaactgttccatttttaaagagctgatggaggaaggaaaggcacggtccaagtggtaggacaatggaaacagtacaaaactcaataagcttaagtgaaaatttctaaaagaaatatagtatcaatatcaattgttacaaaaataaaaacagtcatattttattcctagttcacaaattagctgacaaacccctccttccaaaatcttaaagattcattgtaatttctgaagagtcatcaactctggaatacatcgaaggtagacaaaatccccaagtgcaggcagcctatactcataaaggtaccctattctttttcttttttttttttcatctccagccatacagaggaaggtatccttttctttataatcaccaagtttcaatcttctactaaggatgaatgaaaagctcaatgttacaagcaaagaaagcttttattaaaaagcaaagctattaaaatactgtgttatgtaaaggcattcagttatactacaactactccccttcaaaattccttcaataaatgctaggagatatggagcataaaaaagtagacaatacaattgaaacttattaatttgagacacggtgatggatattacttgatatgaagaaactaaaactggatgagagttaagatattaaaaaaaaaaaaaccctacattaacatttgagaacacatgtacacacacacacacaaagagacacacaccacgagtttgttgtttcttaatttccaagaccctgattcatatgccattcaagctaaacccataatccagatttcccgaaaagatcagtggttcttctaacacatcactcttattttttagataatgatctcaaaaaacctcatctccaaacatatgtgaatctatataatctgcctaaatgtaactggctacattttccactttccatacaaaaagaatctttttatggccgggcacagtggctcacgcctgtaatgccagcactttgggaggccgaggcgggcagatcatgaggtcaggagatcgagaccatcctggctaacatggcaaaacccgtctctactaaaaatacaaaaaattagctaggcaaagtggcaggtgcccgtagtcccagctactcgggaggctgaggcaggaaaatggtgtgaacccaggaggcggagcttgcagtgagccaagatcgcgccactgcactccagcctgggcaacagagtgagactccatctcaaaaataaataaataaataataaataaaaatacatacttttaaaatataaatatcattcaaagctgtttaatataaattcacttcaaattgaatcattaaagtttaactttataaaaaaaatctaaaatgatttggaatatgaaaggatcctaaacaaacaaacaaaacacccttaaacttgacacaggtcctcaacatcaccaagattagtacggttgcttagcatggtaactgtggaatcagactgaggggctccagcattaggagcagccacataggaatcacctctactcactgtaacataagacaactgtttactgtaactctggttgttcatttctctaacaatttcatacacacatcttcccgttgcttagtctgaactgtatactgctagtcattatcataaggaaaaaaaaatctcagactaatataatagaggccaaatttagagagaggaataaaaatcttccttcagtctaggctaaatggactgattacacaaagaactccatacatccgaaagcacacagatgtctgcactagttcccagggctcaaacaataccagtcattcaatagctttccctttacgtaagttgctatgagagagctcaatcagctcttgtgaacctcataatccaggatcctggaactctgaaaagtctacatttttcctcagcactgttttcatgtactttgtctggaactcaaacttcgtatttcccccaaaaaataaatctggaaatcatctcttctgtttgacaaatgatgtactctacctataattacttttcaactaaaaccacaatccacgatacaaatctaagatcattaacactgaaagatcatctgatgaatatatttttcagtgtaggagtttaaaatataattttaaatacgctccatcatttgtacatatatcaaatgtatatataccatttgaccagattctatttgtttccagttgagtcgtttttaaaataaccatgacacaaaatgacttctcaaaattaaaagaaattttgagaggactgttaaagctggggaggggggttgaatttacccgctctctctcccctactctcccctcctctgcctcccacattaaccacacacatcaaaaataatacaaaatatttcactgggtgtttgaccaagcctttagtccacagaaagagttattcttcactgaaccaccttcagaagctaaataacactaccttctaccttcaaagtaaattgctactgattcttccaataatcttttttatcagctaagtctttggtgaattctcacattcaataatgagaaataacaaggataaattaaagccacagaaactctaaagtattttttaatcaaatggcgaaattacttcagaagatacttatcagacctgctacccagaagtaaagctcattagttttggggaacaaaatgaaaatgattaatttactcactgaactgttagatcctgaagagtcaagaggaactatatacattcagttccctttaataatgtactatcaggtaatcattaatctcttatagaaatgatcaagatcccattccaaaatttggtaatgaagctcataacagctcttgtgccccttctaattattttaacactcttcctctcttcacattcatgttacataatgcaaataaacatgctttgaagaagaaaaagttgtctctcccaagttttctgtccttaaacagtaaagataaaccaaaccccctctctccaaccagagtacaaaatgcagaactctgaacataataaccatttaacagatatttcattaaatttcaatcatcacccttacagtggtaaaattgaacttgtcaagaagaggggaaaaaagaactttatcttttcaccacggtattcttccctaatgacgactacaagcaccaaaatcctatgtgttctacaaagcagtaacctcagaaacatttcaacaccctctgagccttacaaactctgttagcaaaacacaaactccgtttctcaaaaatatctataaagttctcaacaaccaaattctttgataactacagttacatctgagacctcctcctcaggacatccaatcgtttttcctacgatcagagccactacaatatttcctggtgctttaagagcaccatcttgcttcaacaaacacgttttaatttcactctaaaaaatacatatttgtatttccagacatctccctctaaaatttccctatactactgcccacataatcctttacagtcaaatcagtcttctcatttttctacaacatggcatcctgttcaacctctgtaaccaggcctgatatcaagataaagaagcacatataaacctttcttccattctccccaagttctcatttattacataaaaagaattcactcctttctataagtgaaatgagttttaaagcattctaatacaactgaaagctaaagaaaacaaagtattaaaatagtacaggttatttatctttggattttaaccaaatattagtcattttaggttcatgttcagatagttatctatacttagccatgacagactagccatgacaatttattcaataaagaaatatcacaaaatggtgtatactaatagtagaaatgagacatagtaacagagaagcaatgtgaggatacagttcacactctgaaatgagatttactcagagctttaagttttccttctcattagaaaataaacctttattgcaaatatatgtttagctaactagaaatgagttatttaataatttttatttttcattcaatactgacattaaataacgcttcagagtgtaacaaaaaaacactagtatcacagtatcattgtgtatataataaaaggtataagatctagattagtctatctcatcttgggctatcaaatacttctcatttcattccttcttctctctctttaaattatcttctgatatcacaaaaaataaatacagaagaaaacccaagaaatataaacatggctattagaaacccaaaacgatttacagaaacactaagaacacaacacactgggcacagtggctcacacctgtaatcccagcacttggggaggccaaggcagagcgattgatcacttaagcccaggggttcaagaccagcctgggcaacacggtgaaattctgtctctacaaaaaaaaatttttttgagacaaagtctcactctgttgctcaggctggagtgcagtggtgcgatctcagctcactgcaacctctgcctcctgggttcaagtgattttcgtgcctcagccacccgtctagctaggattacagatgtgcgccactacgcccagctaacaaaaaattttttttagctagccaggtgtggtagcgcacacctaaagtcccagctacttgggaggctgaaatgggaggatcacttcagcctgggaggctgacagtgcagtgagctttgattgcaccactgcactacagcctgagtgacaaagcaaaaaccctgtcaaaaataataataacacaacgtaactttccacattcaagtctactcaacaaagaagcccaaagaatctaaaattcctgttttcgatctttcttttctcataggggtcagggtggtgtatgtcagtggagaaaaaccgaaaggaggtatgatgatcttcgtacactgtacaaaaacttacccacttgaaggatctaaggcaatagctctgggttgatccaactcttgccaaaataaaacttttcgtaaagatccatctaaattagaaacttcaatccgattagtttcagaatctgtccagtacaatttttctccaagccaatcacatgccagcccatcgggggacaataatccagaaacaacaacattctgcacactctcagttttgttaaattctgttcgtttaatggcttcttcgctgacatcactccagtatatcaagccatgactaaacacaaagtccaccgcagctgcatcctccaagcctccaactacaatcgtagcattctctttgccatttgtagcatcaaccaatcgcaagtcccgtctgtttgcataaagcaacaaaggggccgctagaacaaaaaaagaaaaatatgtaagtgaaaaggaagaaaacgtattggttcttataaactgcgtttcaaatcggtttaagtgagcaaagactgtcgaaaataagaaaagaataaataaatcattaggagaccatctaaacttcacacacaaaatattatttttgcagcatttaaaaaataagacataggaaatggggggaactatttccaccacgatagtcttttcttgttaaaataactcagataaaattttaaagcctggctataccaagaattggcaataatatggagctactggaacactcatactctactggggtgaatgtaaaatggtacagccacttgggaaaacagtttggcagtttcctaaaaggttaaacatacaacctactatacaatccaaggcaatagctagatactgtttattccacatctaggtatttactcaagagaaacaaaaacatatgtcaatacaaagacttgtatgcaaatgctcataccaatttatttgtaataacccaaactggaatcaacccaaatgtcatcaacaggctaatggataaaaaactgtgatactgccatacaacagaaaataatgaaccctttgtacatgaaaaatgggtggatctcaaaataattcagaatgaaagaagccaggccaaaacaaaggtatatattgcatgactctcatctatataaacttttacaaaaggcaaacttttgtaaaaacacaaagcagatcaatggctgtctcaaaatagggaaagaaggtgcaaaagaatgagggggaggattaaaaatgggcatgagcaaacttttgcaggtgatgagctatattatcaataatgatggtttcggaggtgtaaacatgtcaaaacttattaaattttacacttaacataagcaaaatttattgtctatcaattataccttaataaaactgttacagtttgacagaaatagttcttagtaaagctactttattctgttctatattactattaaaatgacctttgaaaagacccgaaactaaatataaagccaatcttacagaaataacatttaactttgagaaagttgaagctgttgggagtgaggtagtataaattccatgttttttggtttttattaaatatctattccaagcttctgacatttactttcctagtatcaagcaacaattaaaaatctagagcactactgtcctacagaactttctgtgatgatggaaatgtcctctccactgcataacacagtaccaccagtcacacgcagctatggagcgcttaaaatgtggctagtgtgactacaaaattaaatttttaattttatataaactttttttttttttttttttttttgagacagagttttgctcttgttgcccaggctggagtgcaatggcacgatctcagctcactgcagcctccgcctcccaggttcaagcaattctcctgcctcagcctcctgagtagttgggattacaggtgcccaccactatgggtccggctaattttttgtatttttactagaggtggggtttcgccatgttgaccaggctggtcttgaactcctggcctccggtgatccacccgccagggcctcccaaagtgcttgggattacaggcgtgagccactgcgcccggccccaattttatataatcttaattcattccaatttatatagacaagtgtggctagtggtagtattggatagcacacatctagaggctggaatgcagaacataaatgaggcagcaaaagtaagaccaagccaggcacggtggctcacgcctgtaatcccagcactttggttaagcccgggagttcaagaccagccttggcaacacatggaaaccccatctctacaaaaaaattaatttaaaaaagtagccaggcatagtggtgcacgcctgtagtcctaggtactcaggagactaaaatgggagggtcacttgagcccaggaatttaaggctgcagtgagcctgggtgacagagggagaccctgtctcaaaaaaaaaaaaaagagtgagttatgatacaattatctacatgatcttctttcataattacttactaagggtctacaactgtgtcatctgaagccaagcccaactaccatttagaagtaacgattccccttttcaagaaattactccaatctcaaaaaagtgtaagaaaaaagtgatgtttacactatagattgtgtctgtcaaatagttataaatgtatactattttcatctataagtacaacataaacttccctaactaagcttaaatccaactttcttagtcaaaaacaaactggcagacagcttttttaaaaagtggctaaccaatctttctgcttattctgtgtatctgctgcagctatcagcaaattcataaacttccctaacagagtcacttttaattcatttctggccttcacacatcacactgatttatcagtccccacagagcccactatactgagtctctcatactatgggccaaatataaacatcagaaaaaaggtccctactagtgaaggatacaatgctaagtgctgcataaggctaaggaatacccacgaaacacttaaaattgaaaattcaagagtgataatcatctaatatttactgggcaccttctttatggcactatcttggaaaactatatcaaagctataggacattaggtggcagccaaatgtctttcattgctttcaagtcaaactttaacacttctacgtgtactgaatatttttggtctacaaaatccaaaaacgctttctggtcagttaaggcctcacaagcattctgagtctcttctccctcctgaaaacgggtgaaggaggcaaagttaatcttttttaagttagcaatactggttacaattgaggatttgtaaaggactgtacataaatctgctgcacataaaccacactattgaaaggaaatcccagggttcatcctgtccaaccacccttctgatgcttgaatactttctattacattgtcaccagtatctgttcagcaacatattaaatgggatatctgataggtataatttgatttgtaacattgtttttatctaccaaacagatacactggaaccacatacttgctccctggaacatgccagtatcttccattccagagagcttactttctgactgcctagtattcagataacccaaataatcaccatcacttctcttcagtggaacactcacagtgctcaggaatccttgttttcctttattaaactcctgggaaactttctctaccagcctttctaagccttttctacttttaaagactaatttccatgccctgaatcctttatcctcagatcatctcataaaacaatctcagtgaagcaggatacaaggtaaatgtcatacatccccaacatcttaatttatacctctcaaaattttctctccacccatcttcccttaccttgtcctcagtctcaaatgagaagatggccttcctcctaaggctaaagcaatactttcggttcagcctccttacctcctctctacaacttcgctctatcaattgttctgtatttctcgtattttcaatggtttacgccaggttccttgctattgttttgttttaataaccctaaccttgctaccatcagaataataattatatttctactaactgcaaaatcttataacattggtatatatacttcacactaccattcattagctattactcttttatctaacttcctatccatcactcaactgcaagtgcttcctctaaatctttataaccaaatccagtggtcttttctcagtctttactcttttttttttttttttttttttttttttgagatggagtctggctctgtcgcccaggctggagtgcagtggtgcaatctcggctcactgcaaggtccgcctcccgggttcacgccattctcctgcctcagcctcccgagtagctgggactacaggcgcccgccactacgcccagctaatttttgtatttttagtagagatggggtttcaccgtgttagccaggatggtctcgatctcctgacctcgtgatccgcccgcctcggcctcccaaagtgctgggattacaggcttgagccactgcgcccagcctctcagtctttattcttaacacctctagagcagtcaatgctgttgactatatccctacctatatagaatgttctcctcatacaatactacctattttttcttgtcttgtttcaaaccttccacttcctatatataggtatcctaagactctctgttgttccaaatgacagagtataaaaaattaaagttcacaagcaacagcaacacaaggtggcagccaccacaggctcgggggtaaaagtcccttgcaatttcccacttttggaagaactcaaagaaggccagaaaggagtaggagatggcagttagctgaggtctagacaatgataaagacgtgacacttacaagacgtacagggatgataattgggcctgcaagaacaatttatgaaaactgaatatacagccttaaaataaaatgtggacctaaatacccagaagcacccccctttgtaagatttgtaacaaaaaattaatatgaatggagttaatagttctaatggattggtggacccaagagccatatcagtgctagcaaaatggcagaattcacagcaccaaagttgtcctgcaagagctttggcgcctaatggtgtctaaagaaaatatgaaactccctcagccacctcaaggacagtgttacagcaactaatcgaaaagaaaaaccacaacacagtgttacagcaattaatcgaaaagaaaaaccacaggcccttcctcttccccctcattcaatttaagcagtcttcattttccacagcagcaaattttctagatatgtcttgtagacctcaaagtactggaaaggaagctcccattcaaaggaaatttatcttaagatgctgtaaaactaattttttgtccatttgaaatatataagttgtgctataacagaaggaaggaaggaaggaaggaaggaaggaaggaaggaaggaaggaaggaaggaaggaaggaaataaattaattaaagttcacctggtcaacaagcaattctatgcagctaattcccaaaacatcatctctagttctgtccctctaactttttgttggccatctctacctcccgttaaattaaattcatcacctttcccccaaaacaacaaaatccctcaccagtcaatggtacacaattctaaccttactggcatgccttggagccatctttgagcccctccccttttcccctagtctgacaattactgtcttgttgactcttattttacaagcatgtctttaaatctgtctcctcttctccatttttaaaaccactatcctactctagaccttcatgactttaggcctaaaatatcctaatagtaagttatctcaatattctcccctttccttttctacttctaatactttcagtttagccaactcaaaagccattctgattccccttgcctaaatttacaaaatgcctcaatacctcagccttccaccatgacttctacctaggactctaaattaatcttttatagtctctgcatcatacaaacaggtttcaaaacatgtaaactgggagtacatcacacccatcattgcagagtattcattttcctgcctactccatacttctctttttctcccagcaagcaagtccttcaaggccagagtcaaaccttacctactctgtaaccctttctaattgactcagctttacttcttttaatccttagtctttagtacttacatgatattagctttttttttttttaagcatacttcctacctctaggatctcagcccttggaaacaagaaccataccttataactaattttatcatcaatgcctactacagttcactgcacacagaaatatcatatacatatttactaatattttgggggttttgttttgagacaaagtctcactgtgtcacccaggctggagtgcagtggcacaatctcggctcactgcaacctccgactccctggttcaagagattctcctgcctcagcttcccaagtagctgggactacaggcgcccaacaccacacccggctaatttttgtatttttagtagaggcaggtttcaccatgttggccaggctggtctcgaactcctaacttcaaatgatccacccacctcagcctcccaatgtgctggggtaacagacgtgagccaacgcacctggcttgatttttttcttcttcttcgtttttcgagatggggtttcgctctgtcacccaggctggagtgcagtggtacaatctgggcttaatgtaaccttcacctcccaggttcaagtgattctcctgcctcagcctccctcgtaggtgggattacaggcgctcgccaccacacccagctaatttttttgtatttttagtagagacgtggttttgccatgttagccaggctggtcttaaactgctgacctcaagtgattcgcccacctcggcctccgaagtgctgggattacaggcgtgagccaccgtgcccagccaaagccggctaagatttgacgggtttatttgtaagatgtttttaagtgcttatcaaatattatagttacgtaaaactagattttagttttctctgttaaaatgacggattttcttcagttattagtttgtctttttgatttttgttttttgagatggagtctcactctgtcacccaggctggagagcagtggtgggatctcagctcactgcaagcaccacctcccgggttcatgccattctcctgcctcagcctcccgagtagctgggactacaggtgcccgccaccacgcacggctaattttttttgcattttttttagtagagacagggtttcaccatgttagccaggatggtctcgatctcctgaccttgtgatccacccacctcgacctcccaaagtgttggaattacaggcatgagccacggtgccccgcccattagtctgcttttaataaagaagttattaaaggttttcctttgccttctgaataatctccacagaaggcaaagattgtgtcttaccagaatttcctgtgcttaatgctgactttatcatgtccttaattacttaaaactgtattcacacccttaaaagggtaaggttcttcaccactgcattacctcccatgcttacttttttcaatattttttttaagagacagggtctcaccctgttgtccaggctggagtatagtggcacaatcatggctcattgcaacggcacaatcatagctcactgcagcttcaaactcctgggctcaaacgatcctcctgcctcagcctcctgaggagctagaactataggcatgaaatctttcgcccagctaatttctgtagagacaggatcccaccacgttgcccaggctggtctcaaactcctgacctcaagtgatcctcccatcttggcctcccaaagcactgagattacaggcatgggccaccgcactgaactaaaatctttttttttttccggtcacttttggttaaatatgtagccaagtatttttttccacagtggcccatgatcctatttaatcaaatgttcaaacctcctaaatgatgccttttgtaccaacaactgtctttgagatttcccctaaggggccctagaaaatcaaaattccctttaccttgtaaaagagagatgttaaaaataatagtttatttgatcaaacgttatgggtcatatggaaagcactgtcaaagccagagaggcttaccctccctaagtttaagttaaatttgtataggtaaaatgttattaatagggatattttggaagttctatgaaggtataaagctcctagaaattcatcaatgccctcattgtccatgtctattaatcagagttctggtgctgctttgcctggtattagacaacagtataatgtcatcagtcataatttcagggattttttttcctcaatgttaacttggtcataatttggcttctttaatcttctaggttggctaatggttctcagttaagaattcacatcatttacttatggaatgctattatatagaagttaacgacctactccagactgctaaatctttttccttgataatcttgatacattcttgatatactctatacatatatacattcttgatatactcttgacatattcatggtccattacatcttaggattatatgtctttagattttctctctgcaatgaatatattcatctatattcataaatgacatgtactagccactcttctttaaaataaggttaatcggctgggcgcagttgctcacaccttaatcccagcactttggggggctgatgcaggttgatcacctgaggtgaggagtttgagaccagcctggccaacatggcgaaaccctgtctctaccaaaaatataaaaattagcagggcgtggtggcgcgtgcctgtaatcccagctacccaggaggctgaggcaggagaatcactggaacccagaaggcagaggttgtggtgggccaagatcgcgccactgaactccagcctgggcaacacagcgagactctgtctcaaaaaataataataaaataaagttaatcattacgcttatagatatgcttttgtctaacacttttttgggttgattttagttcgcatgccacaaaaatcaaacttccttgccaatttcattatcttttctaacaaagtttcataagatctttcactttttttctttttttttattattatactttaagttctagggtacatgtgcacaacgtgcaggtttgttacatatgtatacatgtgccatgttggtgtgctgcacccattaactggtcatttacattaggtgtatctcctaatgctacccctcccccctccccccaccccacaacaggacctggtgtgtgatgttccccttcctgtgtccaagtgttctcactgtttaatttccacctatgagtgagacatgcggtgtttggtttttcgtccttgcaataggagatctttcacttttaagattatcagtaataggttaatcatcaccgttttaagtattttgtcatctacagatagttttctgttttactctaatgcttccctgaaagcacttgcaaatcagctacaggccagagtgcacttgtcttcaataaaaaagggctatgggccaggtgtggtggctcacgcctctaatccccacactttgggaagctgaggtgggcatatcactggagcccaagagttcgagaccagcctgggcaacttggcgaaaccccttctctaccaaaaaatacaaaattagctgggtatggtcgcacacacctgtggtcgcagctactagggaggctgagatgggaggatcacttgagcccaggaggtcaaggctgcagtgagccaagattgtgccattgcactccagcctgggtgacagagtgagactctgtctcaaaaaaaaaaaaaaaaaaaaaagaaagaaagaaaaaggaaaactactacgccaggtaacctgaacacaagcgtctgatggcatcacttaaataactctgagaccacaccagtggactgagtcaagatttccaaacagctagtagaaaaacagatgggttcgtgagactgctaacacagatccagcagaacaagaattaattacataggactgaataaactgatgaaggatgattatgggtttcgtttaaaatattgctgatgccttagcgtcctattttctggatataaggaacccctttctcttttctctgaagctatctataactcacaacaatttaaggagactatgtttttgtaaaccgaaataaacacttatctttttctcccccgtcttactcctccagaattcaaaaactcttattatttttattttcatggcaatatagttatctgcagaggttcaatgagtctgccttctagctggaaacattacttatgcaaccaaggctttgactggaatgccacatttgaaaatattcatttaatcaggtatgaccaaatacttctaagttacagttgactttatgaaccaacgcttacagtcctcttaggaaaactggcctggtaactggcttacagagttcccagccttgcaggtgaattaagcaagatcacttcccggcaggctcaaaaatcctagaatattttgggaacttcaagacaggaattcacccaaatttataggtattacaagtgaaacctgatggtcagttcttgacttacctttatagtctcaagaggcattttaaagtccaatcagattccttaaaaaaactttcagcaaggcaatattaaaagacctattatatgataaattactattattgctacacctatgtaaataatcaggcccaatctaatgagatcaacttctcaatgactcttattccattgtcaacagtgactgattttgttttaaacaacagggagactgaccagtgcacatcacaattgcccattacttactcattgacttggcttgaataaactttagtcaggattctcttctccccacaaattcctaaactttggcttgccctaagcttaagaaagtagatgcacaacttcttccctcattctgaccattagctgactgcagaaaaaaaaaaaaatgctttccagttaaatagtcctggtcatgcaatctgctcacccctacctatttggcccacattcccacaaagttcctgatagccctgcttacttctcctttctataaaaaaaaaaaaagcctttttcggtttgattttgaagtgtgttgcagatcctgtagtaagcatgtccttctactgcaaaaatcctttcaaataaagtctctccttacctaagtctagctttgtttttgcttttgggtttggtcacttttttttttttttttttttttgagacagagtctcactctgccatccaggctggagtgcagtggtgcgatctcatctcactgcaacctccacctcccaggttcaagcgattctccctcctcagcctctcaagcagctgggattataggcaccaccatgcctggctaatttttttggattttttttgtagagatgaggtttcactgtgttgtccaggctggtctcaaactcctaagctcaagcgatcctctgccacggccttccaaagtgctgggattacaggtgtgagccactgcaccttggcctcagctttgtttttatttacagtataagtactatgacaaactacctatttgcaaatgccaaattttacattaatatgtatttccctctatcaaagtcatcagcatctctttcaaaaccacaagaaggcccaggtaaaataaggtacatacagaaagtcctgcacgtaaaattactgtccagagtacaaacaatctggctttagtcattcatctttctgatttataaaacgaaggagttggcccaggtaatttctaatacctcttctattttcttactctagatatgaatttagtaaaaagatttaactgcaacaggacgattgacagggctattcagaaacacgagatactggtaaactatttagtgcttctccagcagaaaaacaggaacttaaaatattttttaggccaggcgcggtggctcatgcctgtaatcccagcactctgggaggcagaggcgggtgtatcaccgagcccaggagttcaaggccagcctgagcaacatggtgaaaccccatctctataaaaaatacaaaaacttagttggaaggatcaccggagcctgggaaggtccaggctgcagtgagcaatgatcgcgccactgcactccagcctgggtgacagagacaccagctcaaaacaaacaaacaaacataggccagagtggtggctcatgcctgtaatcccagcactttgggagccaaggcaggcagatcacttgaggtcaggaggtcaagaccagcctgaccaacatagccaaaccccctctctactaaaaatacaaaaattagccagcatggtggcacacgcctgtagtcccagctactcaggaggctgaggcatgagaatcacttgaacccaggaggcagaggttgcagtgagcagagattgtgccactgcactcctccttgggtgatgaagcaagactctgtttcaaaaaaaacagatttttttaacgtatcaaaagctgagattcagaaataatttctcaaggtaaagactccaataatcaaacccacactcatttgaaagtatttaatatatccatacaatggattactcagccattaaaaggaatgaagtactgacacatgcaacatgaatgaaccctgaaaatgctaagtgatagaagctagacacaaaaggccacatattttattccatttatatgaaatattcagagtaagcaaatccatagagacagaaagtaaattcatggttaccagaggctgagggaagggagaaatgggaaatgtatgggttttgagggagcaggggatgataagcgttctggaatgagatagtggtgatgttttacaaccctgtgagtatactaaaagccaccgaactagacattgtaaaatggagatttttactgtatgtgaattatagctccaaaaaacttggtttaaaaaagtacttgacaggccgggtgcggtggctcacgcctgtaatcccagcactttgggaggccgaggcgggtggatcacgaggtcaggagatcagaccatcctggctaacacggtaaaaccccgtctctactaaaaaaatacaaaaaaaattagctgggcgtggtggtgggcgcctgtagtcccagctacttgggaagctgaggcgggagaatggcatgaatctgggaggcggagcttgcagtgagccgagatcacgccactgcactccagcctgggcgacagagcaagactccctctcaaggaaaaaaaaaaaaaaaagtacttgatagaaagggcttaatgaaaaaaaaaaaagaaagaaagaaaaaagtacttgaggccaggcatggtggctcatgcctgtaatcgcaagcactttgggaaaccaaggcaggaggatcacttgagcccaggaattcgagaccagtctgagcaacatagtaagaccctgtctctacaaaaaaaaaaaaaaaaaaaaaaaaaaaaaaattaaaaatgagccgggcgtggtagcacgtgcctatagtcccagctactctggaagctgaggcaggaggatcgcctgagaccaggaggtccaggctgcagtgagccatgatagcatcacaccacactccagcctaggaaacacagtgagaccctgtctcaaaaaaaaaaaaaaaactaattatatcagtgcaatagttatatcctaaaaccagaaaacacgttacatagtccacaccttgaattcaatctcagatatgaatatgctgattttttagtagtctatttaacatatctaatctatgctaagaaatctttatttatttattttgaaagacagggttttgtctgtgatatggagtgcagtggcatgatcatggctcactgtagccttgagttcctgggctcaagtgatcctcctgcctcagccttctaagcagctgaaactacaggcatgtgccatcgtgaccagataattttttaattttttatagatgtttcccaggctggtcttgaactcctgacctcaagtgatcctctcgccttggcctcctaaagagatgggattacaggtgtgagccaccatgacccagactaagaaatctttgtaatcgttacaaatttataatttaactatagctaatgaacgattgagtcaaaacacaaaatggcattccaaataaatgtcataaaaattcacatctttttatattactttaaatgtaaaatttacagtgctcaatatgtgcaaacctctggtacatggtgcatataaaggggaaaaaggtctactcttcaaaaacttttcatcaaagagctatttctgcattagcataaatctagaaggttacaaataaagacaatataatgtgtagctaagaattcatggtaatgaagttcactcgtcacctttctcagacttgcaaaacatagtatctttaaactggatatatggatatacagtacttaaattatacgtaccaataaagctaatcattagtgaggaagactcctatcccttgcagtcctttacttgtagtttgggtcttgtagtgataaaacaatgactaagaccattagagaaaatagcctcctggttaaacatacataatttgataaaggtaggtttccaatatttgggtgactattttcttgggaaaaaaaaaatgacagctgtgtgcagcaggctcacgcctgtaagcccagcactttggaaggccaaagcgggtggaccacctgaggtcaggagttcgagaccagcctggccaacatggtgaaaccccatctctactaaaaacacaaaaattaggtaggcatgatagtgggcgcctactaatcccagctacttgggaggctgagacaggagaatcacttgaacccaggaggcagatgtcacagtgagccaagatcatggcacggcactccagcctgggtgacagagcgagactccatctcaaaaaaaaaaaaaaaaaaagactactgctggtcatgttatttttattgagagtctcatcaataactttaggcctggtgttaataacttacataacttaatgtagttttctgcctaaaaatataatttcattttgcatccccaatctcctcctgaaattagttccaaaatatttaagcacttatacaaggtccttccaagcaagatattacagaaactacaagttatgataccgctaaaaggatcacagcatcaaagtatcaataattttcaccgaagagtccaagcacattttaaaagtttctagcctcacacccgaacagcttgaacctttagtgagaatactcactgccgcaaacacgaacagcttgagaaacaaaagcatatgttaataataccaaataaccttgtttccttgcatttatgtactgacaaattgtattttaaaataaataattttaagagcaaacagcctgttcttagattgcctagtctgtatatttgactaaatttcaaagttactcatataaaacagtgttttattcactgaagtgaggcttactttatagaagataaacacccttatccgaagtgaaaacatgcaatgcagaaactcagtatagcattcagccatcctgcagaaagaaatccaccaactgaataattgttgtaaacaaataatgcaatttctcaattagatgtcttgataaaattattttgcccatgcttaactctttaataagtatcacaatcatttgaactgtctgttctgtagcttatttataataatcatcacctaaaatagttatggctgcaatcctttagaaataaatttaggccaggcgcggtggttcacgcctgtaatcccagcactttgggaggccgaggcggctggatcaccaggtcaggagatggagaccaacctggctaacatggtgaaaccccgtctccactaaaatacaaaaaaaattagccgggcgtgttggcggggcctgcagtcccagctactcgggaggctgaggcaggagaatggcgtgaacccggggggcggagcttgcagtgagccgagattacgccactgcactccagcctgggcgactgagcaagactccgtctcaaaaaaaaaaaaaagaaaaaaaatttagtgtcattccgttttatatcaaacaaaacagaaatttccataagtaaaagtattttatggagcttttattccagttgcagaagaatcaaaaaaaattccaaaaccactggcctaaaactatcaactgccaaaaacagtgcccaggacatagcgacacttaaaatgttttaccagtctttccagagtataatgtttcttttaattcggccatcttaataatagcaaccatttattcaatgtctactattgactgtgcgttctactacccctttacaaacatttcgtcagttctcacagaagtcttgcaagttatatccccacctaacaggaaaggaaataacttgtccaaaggaacacaaagcggcagaagagtttaacttggcctgtttaacaacaagccatgtctttctgctatagtaccttccatataatcttctctaaatgtaaactttcaatagaatttctacgatgaaaataatctttctcagagtagttacccatggcctaaatagcactaaacattatttttccagtatgcgcaaaatatttaaacaaaaaatatacgttctcataaaatattttccattaatatatcccttcccagaatctcctttgatatttaaaacagtcctttctgacagccaaagcatatataaggacacagtagttcagtacagcaaatggaaaaacttccaattaaagcaaagaaaaaaatctcttaaaaattgaatcatggccgggcgcggtggctcacgcctgtaatcccaacagtttgggaggccgaggcgggcggatcacgagatcaggagatcgagaccatcctggctaacacggtgaaaccccatctctactaaaaatacaaaaaattaatcgggcgtggtggcgggcgcctataggctgaggcaggagaatggcgtgaacccgggaggcggagcttgtagtgagctgagatcacgccgctgcactccagcctgggcgacagagcaagactccgtctcaaaaaaaaaaaaaaaaattgaaccacaggaaatcactattagcccttctgataataacaagctaaaaccttaaaatttaataaccagacaaattattgtttagccaaatgagcaaacctgaagccaggtaagtaaacaggaatgacagtatcaaattaactatatgaaactgtcatcaaatatcaatgtaatacttgacaagtttggaaaataataggttaaacaaagttaaaaccggtctctttacctcaggacttttcagaacccttaatgtgttaacatgaattctaatctccaaataaagtgtacagagatcactcaaggttacacagcaaatttagaaccataacttaattctcctgattgccactccaaaatttgttctacttccccaagactttataacacctgattttaaaggaagaaaggatcgcttctacagaaatacaagatgcaaaacattagtggtttgttccaacaatatttaccagcccaccaaaacaaaaaaaagtaacgaagaatttttatataacaagcctcctcaaaaaaagctaaaaaggccaggcgcggtggctcacgcctgtaatcccaacactttgggaggcagaggtgggtggatcacctgaggtcaggagttcgagaccagcctgaccaatatggtgaaaccccatctctactaaaaatacaaaaattaggccgggcacagtggctcacacctgtaatcccagcactttgggaggtcaaggcaggtggataacttgaggtcaggagttcaagatcatcctgaccaatatggtgaaagcccgtctctactaaaaatataaaaattatccgggcatggtggtgtgagcctgtggtcccagctactcaggaggctgaaacaggagaattgcttgaacccaggagggagaggttgcagtgagctgagatcatgccactgcactccagcctgggcgacagggtgagataccgtctcaaaaaccaaaaaaatacaaaaatacaaaaataagtcaggcatggtggcaggcacctgtagtctcagctactcaggaggctgagacaggagaatcgcttgaaccaaggaggcagagattgcagtgagccaagatcgcggcactgcacttcagcctgagcgacagagcgagactccgtctcaaaaaaaaaaaaaaaagcaagctaagaaatagtatttcacagattacacacaccgatggtattccaaaacctatattcttatcaaaaatacttccagcagaagatcagatattattttttctcatcagtatccgaatggaactaagaaaatggtaaggatggcaacctaaactgtgaggcccgttagattaggaaacacattgttttactcaccatcagtaccagaggctgacatataggaggtattccatacatatttgctaaaagaatgaataataaatccctgccccatctttaattaacctacctttattaaattacagtatctctgaatctgagtttccccacttacaaataaactggtgaggctcaaacgaccaagatccctttcacttttaagaatgtgtgaatctgggccaggcgtggtggctcacacctgtaatcccagcactttgggaggccgagatgggcagatcacctgaggtcgggagttcgagaccagcctgaccaacaaggagaaaccccatctctactaaaaatacaaaaaaaaaaaaaaaattagctgggcatggtggtgcatgcctgtaattccagctactcaggaggttgaggtaggagtatcgcttgaacccgggaggcggaggttgcagtgagccgagatcatgccattgcactctagcctgagcaacaagagcgaaactctgtctttaaaaaaaaaaaaagaatgtgtgaatctggccgggcgtggtggctcacgcctgtaattccaggactttgggaggccgaggtgggcggatcacgaggtcaggagatggagaccatcctggctaacacagtgaaaccccgtctctactaaaaaatacaaaaaaatgagtcccagctactcaggaggctgaggcaggagaaaggcgtgaacccggcaggcagagcttgcagtgagcggagatcacaccaatgcactccagcctgggcaacagagcaagaatccgtctcaaaaaaaaaaaaaagaatgtgtgaatctgcacctgtaatcccagaactccgagaggcggaggtgggaggatcacttgagcccaggagtttaagaccatcctgggcaacatagcaaaactctggctctataaaaattagccaagtgttatggcacacaactgtggtcccagctacttgggaggctgaggtgggaagatcacatgaacacaggaggtccaggctgcagtgagcagcgatcatgccactgcactccagcctaggcaacagagcaagaccctacctccaaaaaaaaaataggaattcgtgaacctggccaagcatggtggctcacacctgtaacctgtaatcccagcactttgagaggatcacttgaggccaggagttggagaccagcctgggcaacatatcaagacacccccacaccaaccccatatctacaaaaaattgggggcatagtggcacgtgcctatagttcagagctttgggaggatgaagcaggaggatcacttaagcccaagactttgagactgcaatgagctgtgattacaccactgcaccccagactgagtgatgaagcaagactttgtctctttaaaaaaaaaaaaattgtgaacgttatacaaattaaatctcaaatcatgaaagcatttgaggatatgtccctgaacaagcaaaaattatagcaaaaagtaacattaacaaggtactccatattatttcatttaaaacacccaataaccctgcaaactagtcaggtatcattatccacactaccagtaaagaaactgagacctagagaagcggactagaccagaaccacaaagttatgaagttgtgacacttgggctttaaatccaagattttagtattgaaattcccaaatctttcctttataccttgtcatgtgatgatagagatagggacacagcactaacagtattccctggctttctgctactaattcaacagggctacaggacagaaggtctcccagactctcacataccccatcacacccagccaatgttaaagccccaattctttgtgggggaaaaaaatgacctaaatgcaacaaatcaatcagatttttctccttggagtccaaggttgactaaatatctttactataacagaggatgacattctcaaagaatgaattaattctaaattatgaacaaaaatattttacatcaaaagacagttttacttcaaataatatgtactcacagctaagtacagtactgttacatattagaagaccaccttacaccatatttcgccacatttaaaacgagagctccacttctgaaaactttgctagtggaaacgagacaatttaaactattacctcttccaggtcttgttacataaataagtgcaacctatctaaattccaataatgaacaaacccagctctggtctcaaagctggtgttaaacaaacggcatttacatcacacgcttctcctccaagaaatacaactagacaaccagaaacatcccaagttataagttttcccacgactctaaccaatcagctggttctcatatttgtcagccctattaaccttatgtcttaaaatacatacatattcttatgtcaaatatagttgtttctaacagctacagcaaaacccctttcaatagagtatgccaataataaaataagtatatacttatgaaacctctccagtacgtaacacttcattaaaatttctgccacaaaaatctaatgaacactacctttccggggtttacatgtgggaaaactttgtaatatgcttagagtatcaagtaatataacatgcaaacacaatgctgcattactacagagtaactgaagaaagtatttctcctcctccaaaaaaaaactcaatcattctcatccgaaatacatatacacagtacacgcaaaaatatacacctgtcacagactattagttactattagtgttctgtaaacttaaattagtttggagaacttaacaaaagtttagcttgttaacacctaaaaatctccagcgaccagcggtcacatgcctgaaaagaacttactatgaacgccagtaagaactttaccaaaccaaaactacaagccaccgtatcgagcagtacttaaattcctctgctggtaaatgctccacagccatcacagccatctcaagttcaacactaaatagtttgagaagagctgccgacgggccagtcaaaaatctttgtgaactgtcacaaaagtcacagagcatgtgtcagctttgcagtccaattcaaaacatcatagtgccatcgaattcaagcgattcccagagcaaattatctcgaacagcctatgcaatttaccaaagtgccaagcagtccccaggggtgcagagcaaattatcattttggtcccaggaccggctcctcttcacacgaggatgaatttccctacttagtgccaactgtacacttgcatactccgaaaataggggcaagccgtgaataccagaggttacaagggcaatgttttattttattatgggctgaagctcagaaggctcccaatgctgaaacgctcgacctataaccccggagtcactttccaactgcgctctcacccagggtcattatatcccaaacggaagccaatcattacctgtaacaaggcctggaaaaaatagcaagagggctttaaaagttcacctaagaaacaccgaaacggggtggggagtgggtggcggggcttcgatggataaggccaaccttaaagcatctcggactcaaacattttaaaagccaaaatacgtacaaagacccttttccctggaagaccccaggcagagagaggcacacagacactcagtcatcccgacagcatggggtgccaagggttccctaagaccagcagccgggatcgaagctccgatgtgtccggggaaggtctgggaagccaggccaggtccgcattgtggccgggcggtgcacgcagcccctgctcccgggcccctttctctccccctccccacgaccaggcctctccccgctcctctccccttctcccttcctccgtccctcccctccccctagacacatacaacaaggccacctccccccgaaccccaccaactttccagtgcccccactcttcccacctctcaggagcacacagaagctgcaggccaggaggctcctcaggacggcccccatcttcccttctcgcgttctcttctctcaccggcgaggggtggccagaagtgggggaggcgaggagccggggcggccgccgcagcggcagggctgcacgctcatacttcccagcttcccagcgagagaagaaagaaaggggcacgtcaaggttccgcgcgcgccgccgccgccctctctaccgcgccgctcggccccgggctcgcgcgacgccagcgtctgcttccatcccgccgcctcctcccccggcgccccgcttcccccgcgcagctcctcattcagcctctgcctcgcgcagcggcgcagggatacggtcggcaccgcctcctagggtcgccgcgaccgtgtccctgcgcgcaacgagccccttctcccggtactgcctcctgtacggccagggaagggagtcggcaaccgcacgcacagcctctgcctgagaccctgggagaggttctgggctagcagaggcgaactgggagggaaagcctcctcccggtggcgcattccagcgggattctttcccggaccggccgcttcggccctccccgcggagggcgtgaggcggcgttgaacaacattggagccggcgtggtcgggactactttctgcggctcggccgggcagccgtctgccccgctctttgtgcggccgccgccggcagggccaggtggggctccggtctcgcgcccccagccacctgagactgcccagccgcggtgcacgcgcggggagccacggcggatcccgttgcggggtgatgagctccgtcttcggggttggaaatcggtttcagcatcctttttttgggagggcggaatttttgaacgctgtttacaccggctttcagcgtggatctggtgaacgatattaaaacgccaattcaaaactgagattgtcatttttctcccgccttcccagaaatacaaactgcccccagaattaagcccgaccagctaaagatttctaaactggcagataaaattccaagataaatgcctcaaaacctaagagcaaagggacaattggacaagactatttaggattttacaagttgcatataataacgaatgtttggcatgcttcgattatcaattctcagcttgagaaggaaaagattccctagaatctcagactgtgcacagcctctgctactcccagtgcattgggcattcaggagtaatggcccagacgccccctgaaatcacctgccaggctttcgtctgggcagaggcgctccaacagttaaccctaatggagccatcagatgcatcctgcccagctgtcacacgcccttacctggaggcagatgggcaagaaagtggagctgctaccacaatgttaacaagtacctcagtgacattggagttcactagtgcttgaacacaagttatcatatttgacactcaaaactaccctggggaaaggcaggttttgttacttattctttattgcacagaggagcaaaatgagaacctgagaggttaatgacttacccagggccactcaagtaatgaatagcagtacctcagcccaatccaggtctctgacttaagccactccgctccttccaagaaatgcgcgctgaaccaaaggtgctgcaggtttgtaagtagatggacagcagaaacagccaaatcactttctcccaaattcacctgaggtctagtcaccgtttatttaaatgacctgcttctaagaaccaagtgagttttgtattctggcttcctcaaagcaggaaactgggccgggggcgggtggctcaggcctgtaatcccagcactttgggaggccgaggcggacagatcacgaggtcaggagttcgagaccagcctggtccaacatggtgaaacccccgtctctactaaaaatacaaaaaaaattagccgggcatggtggcacacgcctgtcatcccagctgctcaggaggcagaggcaggagaatggcttgaatccaggaggcgcaggttgcagtgagccgatatcgcgtcattacactccagcctgggcaacagagcaagattgcgtctcagaaaaaaaaaaaaaaagaaaagaaagttaaccttcactttcacaggccccttccaatgtctggggaggggcctttatggtatgttcacatggtcctatttgcaaaacaaagataattttgaattcctcttctgtataattgtattatacaaaattgtataagcttcaagtcccacaaagcctggatctgtccctatttataatagaaaatgcggtacaactggccgggcacggtggctcacggctgtaatcccagcactttgggaggccgaggcaggcggatcacgaggtcaggagatcgagaccatcttggctaacacggtgaaaccccgtctctactaaaaatacaaaaaattagccgggcgcggtggcgggcgcctgtaatcccagctactcaggaggctgaagcaggagaatggcgtgaacccgggaggcggagcttgcagtgagcctagatagcgccactgcagtccagcctgggcgaaagagcgagactccgtctcgaaaaaaataaaataaaataaaaaagaaaatgcggtacaacctaaatctcctcagactatcaacctaagtaggggaatgagatattacacactgctgaaaaataataatttagaggattatgcaacagtgttgaatgtttatagtgagttaagctttttttttttttttttttttttttgagacggagttgtgctcttgctgcctggactggagtaaaatggcacaatcccggctcaccacaacttcctcctcccaggttcaagtgattgtcctgcctcatcctcctgagtagctgggattacaggcatgcgccaccacacccagctaattttgtatctttagtagagacgggctttctccatgttggtcaggctggtctcgaactaccgacctcaagtgatccgctctccttggcctcccaaagggctgggattacaggcgtaagccaccgcgcccggccgagttaagcttttaaaaagtgaaagtgcatgtacatttgattatagctatgtaaaataaaaatatatataatatacaaacataaatgcacacacatatatatagcacatatttgagcaaagaccaaaagtaagtgcactaaaataggcattaggatggtgaaataatatgagatgtagtttgcttttctgttcttcaattttgtttaatgtactatatatttactacaaatttttaaaagatgcttaagtgaaaatctataggttaagcttaagccctagagagaatgccattattactgcataactaattttgtttctcattcttttaagtgccaatcagataccaatcactctgttaagtgttggggatataaagatgagagtaatcatagtccctaccctcaagaagcttacagcctagtttggaaacactgattaataaagtgagtaattaaaatattaaaatctgcagggcacagtggcatacaactgtaatcccagcactttgggaagtcaaagtgggcagatcacttgagcccaggagctcgagaccagcctgggcaacatggcgaaaccccatctctacaaaaaatacaaaaattagctagacatggtggcgtgtacctggagtcctagctattcgggaggctaaggttggaggatcacttgagcctaggaggccaatgctgcagtgagctgtgatcttgccactgcactccagcctgggcaatacagtgagaccctgtctccaactaaaaaaaaaaaaaagacaaaattgctaagtgtagagatgcttttctgcctagacaattcaaagaagggaaaaaagggccaggcgcagtggctcacaactttaatcccagctactcacgaggctgaggcacaggaatcacttgaacccaggaggcgaaggttgcagtgagccgagattgcgcccctgaactccagactgggcaacagagtgaaactctgtctcaaaaaaacaaaacaaaacaaaacaaaagaagggaaaataaccctagcgctgaggttggaaatacaaatcagactttgccaggccaacaagactgaaaaaaaatttcaatcacaatagtaggtttaaagacactgaatcattagagaacttagtatgttggggatttgaaagtagattcatatagctgatgcatggaatgcttttagagaatgtcaggaattgaggcaggaccattaaatagctattgattaataaaaaccttttcaagccatgctaagaagtttagattttagcatattaacaatgcggacattgaagaattttgcacattgtacagaagtctatgaaaggggcaatcaggacagcagcgctgaggactgaaaagacatcatggatttaaagaatacgagattaaaacaggacttttagttgtgaattgagagagaaacagagagtaatgggagtctcctttacaaagaaaagaaaacctaagaagtatttcaagaaggagtgggtaataagtttaacaatggctcttttgtattggaggtgtctatgaaacatccaggtggaggccgggcgcggtggctcacgcctgtaatcccagcactctaggaggccgaggtggatggatcatctgaggccgggagtccgaaaccggcacggctaacatggtgaaaccccatctctactaaaaacagaaaaattagccaggcatggtaacacgtgcctgtaatccgagctactcaggaggctgagacaggagaattgcttgaacccgggaggcggaggttgcagtgagccaagatcacgccattgccacccagcctgggtaacagagtgcgactctgtctgaaaaaaaaaaaaaaaaaaaaaaaggccgggcgcggtggctcacgcctgtaatcccagcactttgggaggccgaggtgggcggatcacgaggtcaggaggcccagaccatcctggctaacacggtgaaaccccgtctctactaaaaatacagaaaattagccgggcatggtggtgggcgcctgtagtcccagctactcgggagaatgaggcaggacaatggcatgaacctgggaggcggaggttgcagtgagccgagattacaccactgcacactccagcctgggcaacagagtaagactctgtctcaaaaaaaaaaaaaaaaaaaacacttattgaaattgctaccactggccgggcacggtggctcactcctgtaatcccagcactttgggaagccgaggcagacggatcacgaggtcgagaaatcgagaccaccctggccaacatcgtgaaaccccgtctctactaaaaatacaaaaaaaaaattagccggtcatggtggcaggcgcctgtaatcccagctacttgggaggctgaggcaggagaatcgcttgaacccgggaggcagaggttgcagtgagccgagatcgcgccattgcactccagcctgggcaaaaagagtgaaactctgtctcaaaaaaaaaaaagaaagaaagaaattgctaccactaaagaaggtatgattagtaatggcaaatgcagtgttaactgttaacaacagagagtctgctgtgagaagtgctgaaaagagggcattgtgactataactttctcgaacgtcattgatgggaacatacattatgccagtgttttagaaaatcagtctgggagtaaaatacatacacctttaaactgaaacgctggccgggcgcggtggctcacgcctgtaatcccagcactttgggaggctgaggcagacagatcacctgaggtctggagtttgagactagcctgggcaacatggtgaaacccctgtccctactaaaaatacaaaaattagctgggtgtggtggcaggcacctgtaatcccagctacttgggaggctgaggcaggagaatcgcttgaaccccggaggtggaggttgcagtgagccgagatggcgccactgctttccagcctggcaacagagtgagactccatctcaaaaaaaaaaaaaagcctacaaaaatgacagttttcctggttcaacctaatcaaaagaacctgaagcctgctttttaaaaaaaatcacagataaagtgcacaaaatagtcattggtgactttaagccaaagcagtttcagcagaggtatgagatccaaagcaaaagtgcagtgaattgagaaatgaaggggaaacagggagggagggcagtggtttttcccaaatcttattgttaaaggaaagagaacacttgggtggctggaaaggaatgtgaggctggaggaatctgggagttgacttagttagggttgattgcttactttgtttttaagtttgagaggaatgtgatcatatttgtaacctgaagtaagtgatcaaataaagaaggagagtgaggaaagtgattcagagacttcaagaggatctggagcctagcagaatggatcagccttggatgggaggaggagcaggaggatttccacttctggaggagaggagagtcagtgtggctgcttgaccttcagctctcctttctccactcccactttcacagactccttccagaggccttgggagggaccatggcaatgattaggatggtcatatgtttttatactacttgcaaaaccaagattgttttagtattcattttctttaaaatatctccttctccagttgtatatgctcagcactacaaaacctgaatctgcccctagtagctataaataggtttcatggggaagggatagtggagacaagatttgattgccttcatttacataaaaacagaaagcaaagtctacattgagagtgaagtaagaaagaatatggtggtcggggaggaggtcaggaaagtgacaaaggtttggagaagctgggaatggaagagggagttgacaaaggacacattataggatcctctaacagcacagaggatgctgctataactccctaccagaaatgtggtgtatatcatgaagagtggccttcttgcctctatttttcttttttcttttttgagacagagtctctctctgtcaccaggctggaatgcagtggtgtgacctcggctcactccaacctccacctccagggttcaagcaattcttatgtctcagcctcccaagtagctgggattacaagcgcgtgccaccatgcctggctaatgtctttctttcttcctttttttatttttatttttttattattatttttttaatagtagagatggggtttcaccatgctggctaggctggtcacgaactcctggcctcatgatctgcccacctcggcctcccaaagtgctgggattacaggcatgagccaccgtgccctgccttctttctttttcttttcttttcttttctttctttttttttgacagtcttgctctgtcgcccagactggagtgcagtggtgctatgtcagctcactgcaagctcctcttccccagttcacgcctactgcctcagcctcccgagtagctgggactacaggcgcctgccaccacgcctggctaattatttgtatttttagtagagacaaggtttcaccgtgttagccaggatggtctcaatctcctgacctcgtgatccgcctgcctcggcctcccaaagtgctgagactacaggtgtgagccaccgcacccggcttttttttttttttttttgtatttttagtaggggcagggttacgccatgttggctaggctggtctcaaactcctagcctcaagtgatccagacttgagggacaagtgttccagactcccaaagtgctgggattacaggcatgagccactgcgcctggcccatctatttttccctccttcaatgggaataacacttgttcctagctgcaccatgaaaatatcacatcagatgcctaagaagaattcactataattagaaaataagtatactttggggccaggcatggtggctcacgccagtaatcccagcactttgggaggccgaggtgggcagatcacctgaggtccggagttcaagaccagcctgatcaacatggagaaaccccgtctctactaaaaatacaaaattagccaggagtggtagcacatgcctgtagtcccagcttctcgggaggctgagacaggagaatcgcttgaacccggcaggcagaggttgcggtgagccgaaatcactccattgcactccagcctgggcaacaagagcaaaacctcgtctcaaaaaaaaaaagaaaaaggaaaagaaagaaaagaaaagaagtaactttgttttcaataatatttttcttttttcaacatcagctatataaaccccctgtaaagtctattaaaacatgaaaaataaattaaacgctatacattaaatttcttacgtttgtcccaaacaggatgaaaggatatctgcaatagagggtaacctggaaaagggaagcggagccagagaaaacagaggagggagtccattcaggggagaggatgatggcggtgttagaatattggttacatccagcctggcatggtggctcatgcctgtaatcctagcactttgggagtccgaagtgggtggatcacaaggtcaagaggtcaagatctgcctggccaagatggtgaaaccccgtctctactaaaaactacagaaattagctgggtgtggtagtaggtgcctgtaatctcagctactcaggaggctgaggcagtagaatcactggaacccgggaggcagaggttgcagtaagccgagattgcaccactgcactccagcctgggtgacagagtgagactccatctcaaaaaaaaaaaaaaaaccaaaaaaaaaaaagaatattggttacatcgagaaggattaatctactaagtaaatatattaaagataatggaatcagagtttctaactatcagagaaggaagttacaaatacaacaaagataccttggtgccaatggcaatgaaaatggtggagtaagaaactctaagggtagggaactctcttcctttgcagaaacactgaaaaaactggcaaaagtcatgagaaacaactttattagaactctagaagatagtcaaaggtttacagcaaccaagctaatgcttaataaggataatgggcactgaatcatggtaggagaggtttgtcgtgttttaccttacccttgtccaatccccctgcccagtgcagcagcagtctagaagacagcagcccatgctctcagtgcaggttctcagtttgggaggtgtgttaggccattcttgcgctgctgtgaagaaatacctgagactgggtaatttacaagaaaagaggtttaattggctcatagttctgcaggctgtacagaaagcatggcaccaggatctgcttctggggaggcctcaggaaatgtttactcatcaccgaaggcgaagcaggagcatgcacgtcacgtggtgagaacaggagaaagagagagagtgagggcaggtgccacacactttcaaacaaccagatcacatgcgaacccagagcaagagcatcaccaaggggatggtccaagccattcatgaggaatctgcccccaagatccaaacacctcccacccagccccaactccaacattggggattacatttcagcatgagatttgggtgggaacaaatatccaaactatatcagaagggaatggagggaatcttgttcctgagaaattgtgttcataggttttaatctgtttgggggatccccaaggggactaatgcagggtacttgcctttgttccacttacctcaaaactctctcaggatagaaaagttgctttgtggaagaggtttctcaaaaacattggacagccaatgaataaagcccagatgcctagagcaaaagataacagctgtggcaaaaaaaatacacttgtagaaagcctgagaagaaaaacttggggattgatatacttgcggaataaaggctctgaaaagcccctggttatgtaggggaatcaaaaaggcccaggccaggatacatcctcagaaaaggtctgagaacaccataggcttcacctctggttgatttttaggcttagcacaagtaagaagtgaaggctaaggcagagttataaatggtgtggctagtcagccgggtgcagtggctcacacctgtaatcccagcactttgagaggccaaggcaggcagatcatgaggtcaggagatccagaccatcctgtccactatggtgaaaccctgtctctactaaaaaatacgaaaattagccaggtgtggtggcatgcacctctagtcccagctactcaggaggctgaggcaggagaattgcttgaacccaggaggtagaagttgtagtgagccgagatcgcgccactgcactccagcctgggcaacggagtgagactctgtctcaaaaataaataaataaatggtgtggctgagcattgaagtattggcaccaacacagagccaatttgcaaagacctgatggtactttttcttttttgcctctaggagtttaagaaaatctttgataaaccattagctgactactatgctaaaaaaacagagaccacacaattcaaagaaccgtataaaatagtttagaaaagtcactaaacaaacaaccacaacctacagagagcaacaaaaaatcctggaatggggagaattttatttccagagttaccgcattgttatattcaaaatgaccacttttcaacaaaaaattatgaggcatgcaaaaaacaatgaagtgtgccctgttcataggaaaaaaaaattaacaaaaacagtccttgagaaagcataggcattggacttactagacaaagacttcaaatcaactctcttaaatatgctcaaagaactaaatgtagctggccaggtgcagtggctcatgcctgtaatcccagcacattgggaggccaaggcagatggttcacctgaggtcaggagttcaagaccagcttcaccaatatggtgaaatcccatctctactgaaaatacaaaaattagccaggtgtggtggcatgtgcctgtagtcccagctactcgggaggctgagacagaagaattgcttgaacctgggaggcaaaggttgtactgagccgagatcgtgccactgcactccagcctgggcaacagactgagactctgtctcaaaaaaaaaaaaacaaaaaaactaaaggaagccatcatggacaaagaaccaaaggagaacagtgtctcaacaagtagaaaatatcaataaaggcagaaaaattatttaaaggaaccaaatagaaattctggagctaaaaagtgtaataaactgaaagaaaaaattcgctagacacattcaacagcagatttaagcagtcagaaatatcagaaaactgaagataagtcaattgaaatcatccagtctgagaagcagaaagaaaaaagaatgaagaaaaatgaacagacactaagagaattgtaggataccatcaagtatatcaatatatgcataacaggaatcccagagggagaggagggatagaaaggaggagaaagaatacttgaaaaaaataacttaaaaacttcctaaattttttttttgagacagagtctcactctgtcactctgtcactcgagctagagtatagtggcatgaacttagctcactgcaacctccaccttccaggttcaagctattctcattcctcagcctcctgagtagctgggattacaagtgcgtgctaccactcctggctaatttttgtatttttaatagagacagggtttcaccatattggccaggctggtctcgaactcctgacctcaagtgatctgcccgcctcggtctcccaaattgctggggttacaggtgtgagtcactgcgcctggtcaacttcctaaatttaacaaaataaatgaacatctcaacagatacacaggaattacaaataaagaaacagagaaaactagaatgaccctgtgatgccatattaataggatatattcatataaattcacgattttcaatatatatggataggtatagaaataaatatagttgtaagtgtgtatatgaatatgtgcatgtatttgtgtacacatgaatgcacagatcctagctctgtctaccaagaaaatgtgttagttaaggcctactaataagcaggcaccgagacagaattcaatgtgcaagagatttattgggggagtgtgatagcctccagcatggtccctaatgattctcacctcttggtagtcacatccctgtgaaatcccctcccacactgagtaggactgacctattactgcagtgacagcatgagactttcaggctaaacaataaaagacatagtagtgtctgtgttgttctattgaaacagtcactgtagggggagaatcagctgccatggcatgagatactcaagatgccctatggagtcgtccatgtagtaaggaactgagacctccttccaacaaccaagtgagtcatcttggaagtagatccttgaggccgaagccaagccaccatatgactatgctttggctgacatcttcacagcaacatcatgagagatttcaagccagtgaagctgctccagaatttctgacctatagaaactgtgagataataaacacaatcgacccttgaaaaacgtggaggttagaagtgctgacctccactcagttgaaaatccatgtatagctttttttgttttgagacagagtctcactctgtcacccaggttggagtgcagcggtgcaatctcggctcactgcaatctcagcctcctgagttcaagcgattctcctgcctcagcctcctgagtagctgagattacaggcatgtgccaccacacccagctaattttggtgttgttgttgttgtttttgagacagattctcactctgtcgccaggctggagtacagtagcgtgatctcggctcactgccacctctgcctcctgggttcaagtgattctcctgcctcagcctctggaatagctgggactacaggtgcgcaccaccacgcgcagataatttttgtatttttagtagagatggggtttcaccatgttggtcaggatggtctctatctcttgagctcgtgatccccccaccttggcctcccaaaatgctgggattataggcgtgagccactgcgcccagccctaatttttgtattttttaaaagtagaaacagggttttgccatgttggccaggctagtcttgaactcctgacctcaggtgattcaccctcctcagcctcccaaagtgctaggattataggcctgagccaccgtatcagcccatgtataacttttgactcctccaaaacttaattactaatagcctattgtcaaccagaaggcttactggtaacatagttgatttacacatattgtttgttatatttattatatatactgtattcttacactaaagtaagctagaaaaaagaaaatgtaattttatttttcatgaaaatcttaaggatgagaaaatacatttacagtactatacagtacagtactgtactgtgcttatcgatattgcaaaattacataaagatggatactttgaagtaatgggtaatggtatgcagacctcaatctacagtacataccaagcaattccacttttttcttgtaaggtcatgacttttttctgcttcttgggagcacttccagcatcactagtggcactttgcatgggttccaggatgttattcaagggtttatggtattgcactaaatgcgataaaaaacgtgcaagatccacgagaaatcacttttcactgtgaaatgccatttactggaaagatcagctgctcacacagagatgagtagcatcccactgggttttaagcagatactcacaatacttgatctcatcacaatagcaataggaggtggctgtgaaattataacagtagtacagtatatacaacagttaattttatgcagttatgatttcatattgcatctttacatttgtttacatttatctagacgaaaatgaagccatgtatggtctgtatttgtgtgtgtaagttttgataaatttcaattttttggaatagatttgtgtataatttatggtagtaaatgacaaaaatagactagtatctacatatattttgtgcattcatgacatacctaactttttcttaatttttttgctatttctagggtatatggtttatcttcaagttttttcaaattgttgccaatctccaaaaaaattccaatatatttactgaaaaaagttcatgtataagtggacccactcagttcaaacctgtgttgttcaagggcaaattgtacttattttaagccactacattttgggggtaattgttacacagtaataggtaagtaataccagtagaaagtaagagaaggaagagagattcctcacgctgagatgcagatctgacatttctagaaggagagaagaatgaaggattggagtaggacaagtcttggactactgcattgttccaagaatgaatttaccaagcagattgggagtcccaagccaaagttgtcccctagaggattcctgtattttgccagaacagacctaccttagtacccctgctgggctcaggcactgactgggaataaccctttaaaagttggcctcagtgtgaatagggtgatagatttaggaggcagtagttggggctatctgtcaattatgctccccacagcaggagaactgagtgacacatttcatagctatcacagcaggcctggaagagatgacagcccaatagcaatgagcagagctagtgtcaagatgttagcttctttttttttttttcagacagagtttcgctctggttgcccaggctggagtgcaatagtgagatctcagctcattgcaacctccgcctcccgagttcaagcgattctcctgcctcagcctttcgagtagctgggattacaggcccccaccaccatgcccagctaattttttgtatttttagtagagatggagtttcactatgttggccaggctggtctcaaactcctgacctcaggagatccacccacctcagcctcccaaagtgctgggattacaggcatgagccatcatgccaggctcaagatcttagcttataaataatattttccttgaaaaggaaccagggctccttagagaaatggctgatcccacatctgaggcaggaaaagtataagatgagtctggaacagctggtagtgacagagcaaggaagggctcaagaaatgacagaaacatgtgaaaaggacatagatgccagcttgaagggacttccactggtcaaatcaggaacaatttgagcatcaaaattaaaaatggcagtaagagattataacccattgaataaaataaggaattatgggttcaaacagacataaagacatatacatacatacatacatacatacacacacacacatcaaaagtttgatgaggaatgggatatttacgtggttcatggtggacagatactgcccagatcaaagaaccaaagtcaaaatcattagtaataggacaaattgaaattatgtgctacctgataggatataagaagaaagcagttatcacttctatggtattcctctaaaaggtgtataacctgaatgtaatcatatgaaaacaccagtaaaccccaaattaagggacaagttacaaaataaccgacctgttttcttcaaatgtatcaaggtcatgaacgtcaaggaaagactggggaattgttccaggctgaagcagactagacagacataaagactcagaacaatgtgtgattctgaactggatcctattgctacagaacattttattgagacaattgacaaaacttgagtgagatctgaggattaggtagtgatcatgtatcaatgttaattttctaattttgatggttgcactgtgattacgtaggagaaggtctttatttgtaggaaacaatactaaaaatatttggggtggtggagcaccaagtcctcactctcaaatggtcaaggacaaaaagtcctttgcactgcacttaacttttttattcaactttgcaaatgtttcaaaataaaaaaataaaagtatgcatgctatttgaaagataaacctgttataaatataaggttttatcatttaaatccggagagctctttaacatctttaacttgatgagtagctaccctctttcttttctacccgtccaagcttactttaattcattcacaagactgaatggaatctcaacatttaaatacttaatctctttctttaatctttggcaccaaggaactggatttccccagttgtatgagtcacccgataacaaatttcccagcttaaatagttttaaagttgtactattagtaaggcaacactgttcattgtgtctcagattcaaggatttatagtaacaatgtgttttagcatgcatattctttttcaacatatacgtttttctttgatgccgtaaaaagtctttctgatgttgaacagttttaatgcagttatgccatgatggaaccacccctctcctcactcccagaaaatcacacagcttgatatgtttttagccttcatctgaattgtaaaacactgaattcttacagttttctaaaagaaaaagaaaaaaacttgccattgctattttgggagcatttgtccagataaataaaacacggtcctgatcccaccctgcctgtcctcgcatttctgagagtgaagatacagaacactgcagtcaggggagaaaacatatttttttttccttccctgtcagaatctgttccattgggaggtgaagtatatgaacccaatttttgccttggagataaagagaaaaaaatcaattctaccaagatttactttatgtgaaagcacttaagcagattccctagacatgtgtttctgaagggttgcaccctccagccatctgacttttggccaagtccagagacattttaggttgtcagaactacggggtgggagatgctactggcatcttgtgggtagagggcagggatgttgctaagcatcctacaacatactagacggtccccacaagcgagttggccaagtgcgatggctcatgcctgtaatcctagtgctttgggaggtggacatgggaggatctctcgagcccaggggtttgagaccaggccaacaaacagtgagatctcatctctacaaaaaaataaaaaattagctgggtgtggtggtgcatgcaggttgtcccagctattcaggaagctgaggcaggaggatcacttgagcccaggaggtcaaggctgcagtgagctatgatcgcaccactgcactccagcctgggtgacagagcaagactctgtctctaaaaaaaacacaaaggcctagctcagtggctcacctctgtaatcccagcactttgggaggctgagccagcaggatcacttgagctcaggagttaaaaccaagctgggcaagacctcgtctctacaaaaaagaaaaaaaaaaaaaaaaaaaaaaaggccaggcgcagtggctcacagctgtaatcccagcactttgggagcctgaggcgggtggattccttgaccccaggaggtcagctgcagtgagctgtgattgtgccattgcactctagcctgggcgacaggaatgagaccttgtctcaaaaaaaaaaaaaaaaaaaaaaaaaaaaaaaagctgttagtgccaaggctgagaaaccctgtccaagattaatgcagagtacagagaagaaagaagacctcaggaggaggggggaaacaccaagaaatacaaacacaaaattaaaagaaaaaaaaaaacctaataaacagtgaatttcacaccaatttataaagatacaggattttagggattaacattcctatttggtggcctttcaggatattgctaagaggactttaaggtcattttgagtttttctactactacatttttatcaattctttcaccaagcatttcttgagcacctactgtgtgccagaggctgaggacacaaagatgtgagcttttctcttccctgggggagctgggagattttagtggtggaaatacctataaatgaagaattggaattccaaggacaagaggtaaagggcaagaaaaagagttcttctctataccaagcactcctgcttacctccagtcatcttcattccgctctcaccagtgagtgttattcccttttcacaaaagaagaaactgtgagattaataacaagagcagacaagcaagtgtcgggccctgttctcaatgttttaattaatttatttatttttaaattgttgttgttgttgttgttgttttgagaccaaagtccccctctgtcgcccaggctggagtgcagtgctgtgatttcggttcactgcagccctcgccttctaggttcaagcaattctcatgcctcagcctcccgagtagctaggattataggcgtgcaccaacgtgcccagctaatttttgtatttttagtagagaccgggtttcaccatgttggccaggctggtctcgatcacccaacctcaagtgatccacccgcctcagcctcccaaagtgctgggattacaggcatgagtcaccacgcccagccctcagtgttttctcatgtaactcattttattttttttattaactcattttactttcacaactatcctttgaggagggcattaatatcatcaccttcgttttacatccgtgggtgctgagggaccaagcgtttaggtaacttgtccaaggtcccacagccaggctgtctggccgcagaatccatgcccttcacaatctacactggtgcttctcttatgcttcatccaaggaagaaaatggtagatctgggcttaaaagccagagtgtgactggaaacccaatgctcttctgctacatgatactctcccctgttctagaaaagagctcaacatgctataggctcacaggtgtctgattgcgcctgaagaagtcaaagtcgatttcagttggaggtagcatctgagctcatagtggaggtatatgccagaaggaaggtcagacaaagggagaaggacaagaacagctggaatagaaaacaataaacttcaccatggctagcagtttgttgtggttggaatgtaagctataccagagcaaaggactaaagagaacctagaggccaggtgcagtggctcacacctgtaatcccagcactttgggaggccaagatgggaggatcacttaagcctaggagtttgagaccggtctgggcaacataaagagacctcatctttacaaaaaaataaaattttaaaggcatggtggtacacacctgtagtcctatctactcaggaggctgaggcaggaggatcacttgagcccaggaggctgaagctgcagtgagccataatcataccactgtactccagcctggataacagagcaagaccctgtccccaaaaaaaagaaaaaaaaaaaagaacctagagaagtaaataagggtaagatcaggaagtgtgagctttaacttccaggcaaaaggtaattattaaaagaccataaggaggccaggcgtggtggctaacacctgtaatcccagcactttgggaggccaaggcaggtggatcacctgaggccaggagtttgagaccagcctggccaacatggtgaaaccccatctctactaaaaatataaaagttagccaggtgtggtggcctgtaatcccagctactcgggaggctgaggcaggagaatcgcttgaacctaggaggcagaggttgcagtgagccgagatcgcaccactgcactcagcctggacaacagggtgagactcggtctcaaaaaaaaaaaaaaaaagaacataagcagagcatgatctgacttaacatcaacttgatatcaacccatactttggagtctagaacaaatatttcccattcctttctgtccacatgccctgctcttgttctttttaatctcactttacctggtttaaatatttatttatttatttatttatttatttatttatttatttatttgagactgagtctcactctgtcgcccaggctggagtgtggtgggacaatctcagctcactgcaacctccgcctcccaggttcaagtgatactcgtgcctcagcttcccgtgtagctgggattacaggagcacatcacatctggctaattttcatatttttagtagagatggggtttcactatgttggccaggctggtctcaaactcctggcctcaagtgatctgcccaccttggcctcccaaagtgctgggattgcaggtgttagccacaagcgcctggcctaaatgtgtataatgtgggagaagaagacgaaaaatctggactgcctttcccctagcaattctcagcagctctcaatgccactcaagcctgctgacctgcaggagttattaatgatgacagagtgctgttgaaagcaataagcaatgtgatgaaattacaaccaaaatcacgctttctagattgatgtggttgggtacattttgagtgacagtggtcctattagtaatactcatatagggctttatagtataccaagcgtttttacatgcactctgttgtttgatcatcaaaacaaaccaaggaggtaggtgttatcccatttcacagatgtggaaactgaagcttccagagcttgtttgggtaagtagaaagaatgaacacagaactccagacttccagtctcatcctctctccttgccttcctgccttgccttcctccctctttaacaatattttcttttgttttgtttttgtttttatatgttttaattttcccgtatgagtgggacagcaaaagccaggagacttgatttgtcctcccctgtcttgtgtagggttagcccactgtggcccctacgcttgctaatgcagccccgtgatgtttttccagatccctcctgtcacccttagtggctcttgatcctgatggatcaagagtgtgcttcttggctaggtgcagtggctcgcacctataatgccagcactttgggaggccaaggtcgggggaacacttgaggtcaagagttagagaccagcctggccaacatggtggaactccatctctagtaatacaaaaattagccgggcatggtggcgggcacctataatcccagctacttgggaggctgaggcaggagaactgtgtgaacctggaggcagaggttgcagtgagccaagatctcgacactgcactccagcctgggcaacagagtgagactccatctaaaaaaaaaaaaacaccaccaccatcaccaacaacaacaacagaaagagtgtgctctttggcatggcacagaagactttctgcgtcctgtcttctgtcctcctgtgaccaaccatcctggtttgcccagaactgagggacaggggactttcactgctaaaactgggacagttctgggcaaagtggagcagtcggttactcttgttctccctctccagctgcctaatctgccactctcaaactccaacttctaagatcccagcaattgctgtcctgtttcaaccccctgcctttgcttatgctgttctttttatcgaaaacacatacctctaccttctctcagccacttcctactttttctttaaaactatgttctggggccgggtgcagtgtctcacgcctgtaatcccagcactttgggaggccgaggtgggcggatcacgaggtcaggcgattgagaccatcctggctaacacggtgaaaccccatctctactaaaaatacaaaaaattagccgggcgtggtggtgggcacctgtagtcccagctactcaggaggctgaggcagcagaatggcatgaacctgggaggcggagcttgcagtgagccgagatgacgccactgcaccccagcctgggtgacagagcaagactccgtctcaaaataaataaataaataaataaaactatgttcttaaatgtaggtactgatttctttctttcttttcttttcctttttttttttttttttttttttgagacgcagtcttgctctgtcacccaggctggagtgcagtggcatgaacttggctcactgcaacctccacctcccgggttcaagtgattctcctgcctcagcctcccgagtagctgggattacaggtgcatgccaccacacccagctaatttttgtttttagtagagatggggtttcaccatgttggccaggctgatctcaaactcctgacctcaggtgatccacctgccttggcctcccaaagtgctgggattacaggtgtgagccaccacacccagcttgtttctttcttttttcaattaaaaaatatatatatatggaatgctggtggggctcggtggctcacgcctataatcccagcactttgggaggctgaggcgggcagatcatgaggtcaggagtttgagaccagcctgaccaacatggtgaaaccccttctgtactaaaattagccaggcatggtggcatgtgcctgtaatcccagctaaggctgaagcaggagaattgtttgaacccaggaggtggaggttgcagtgagccgagatcacgccactgcactccagcctgagcaacagaaaaaaaaaaaaaggaatgcttcacgaatttgtgtgtcatccttaagcagggggcatgctaatcttgtatcattccaatttttgtatatgtgctgccgaagccatcaccaaagcatttgtttctttgactgtattgtgaactgaatgtttgtgccccccaacaattatatgttaaaatactaacactgaaggtgagggtagtaggaggtggcatctttataacgtgattaggtcataagggggagcccttacaaatggtatcagtagataccatttgtggatatctactgtgggtgcagtggctgatgcctataaccccagcactttgggaggccaaggcagacggatcatgaggtcaaaagatcgagaccatcctggccaacatggtgaaacctcgtctctactaaaaatatgaaaattagctgggtgtagtggctcacacctgtagtcccagctactcgagaggctgaggcaggagaatcgcttgaatccgggaggcagacgttacagtgagccgagattgtgccactgcactccagcctggtgacagaacgagactgtctaaaaaaaaaaaaaatcaaaaacaaacaacaacaacaacaaaaaaaaacaaatggtattagtttccttataagaagagacacgagagaggtgatatttttttctctcccatatgaggatacaatgagaagatagccatctacaaactagaaagagtgccctcacaagacaccagatctgtcagccacctaatcttggacttcccagtctctagaactgtgagaaatacatgcttgctgtttaaaatgtttattctttaagccacttgctctatggtattctgtgatagcattctgaatgaaaacaggctgtctcttccagaatatgttatgcttctttgtaaggcatcttttcatcccagtctgttgtagaattcctggcatgtagtaggcaagtaataaagctatgcaagcagatcaaatggtgctaggactctgtaagaatttttctcagttcccttccacagatctcttgccagagagaaaaggttcccctcagggcagcaaggtagaagactcaagaagtgagcagagttgagatcatagaaggcttggctttccatgcttaggggtgcaggctttcatgtgtttgcaatggagagtcattaacaggacaaaaaaaaaatcggtggccctttgtctatgaactcaataagagcctgggcaagaaaaaaagaaatgtaggtaaccagcccagcaagaatagcaacaaagaggcaacactcaagcctcctagtatgtctagagttctgtacaccctcctcagggctagaagggcctcagtgtctgagtctacctgagcccacaggtggaagaacaaaacaggaaacatttcctgacccaagaaaatagtttaaattgcaaaggcacacattacagttaggtacaatataaacaattccctggcacatttattgtcaaactttagtgtacgtcagaatcacctgtagggcttgttaacacagagattgctgagtcccatcctcagagatctgattcagtaggtttgagatgtggcctgggaatctgcatgtctaacaagttcctaggtggtgctgctggtctggagacaatgcttctaggaccaccactccagaacccactccacctctctctcatcaacggataacttgcctgtccttgattcaaggcttgcctctttccttgctaacaacatccctcaatctcctttcagggactcattctcctttggacattttcagatctgtgctatgggtggggaggacaaaataacaccttccctcatcagagctaccttaaccctcactctacttctggctttttcttacaacttcaaaaattgtttgtggccgggcgtggtggctcacgcctgtaatcccagcactctaggaggccgaggcaggtggatcacctggggtcaggagttcgagaccagcctggccaacgtggcaaaaccccgtctctactaaaaatacaaaaatcaggcgggcgtggtggtgcgcgcctgtaatcccagctactctggaggctgagacaggagaatcgcttgaacccaggaggcagatgttgcagtgagccgagatcgcaccactgcactccagcctgggtgacagagcaagactctgtctcaaaaaaaatacaaaaataaaaattgtttttattgactactttcattttctcaccattcattctctctttaacctcttgtaatctttcttttatcctgtctagcactctgttattcataaagagtatttataagctgggcgcggtggcttatgcctgtaatcccagcactttgggaagccgaggcaggtggatcatttgaggtcaagagttcgagccagcctggccaacatggcgaaacctcgtctctattgaaaatacaaaaattagttgggtgtggtggcacgcgcctgtaatcccagctactcgtgaggctgaggcaggaggatggctagaacctgggaggctgaggttgcagtgagtggagatagtgccactgcactccaacctgggcgatagaatgagaccctgtcttaaaaaaaagaagcacaagaagagattgcccttcttgcctttgagtacagttttcctgaagatgtgaatggttgaagctgtgacagccattttgttagaatgaaggcttacatctgagcacaaaacgcaacacattgaggatgccaaagcagaacgttgagaagcatctgggttatcaacatcattttgcaactaattaaccaattccagaattacctgtcttcagacttcttgctatgtgtaatgataatcccctatttttttctttgagctggtgcttttcttttttctttttctttttcttttttttttctttttgagacggagtctcgctctgtcgcccaggctggagtgcagtggcgcgatctcggctcactgcaagctccgcctcccgggttcacgccattctcctgcctcagcctcccaagtagctgggactacaggcgcccaccaccgcgcccggctaattttgtttttgtatttttagtagagatggggtttcaccgtgttagccaggatggtctggatctcctgacctcgtaatctgcccgcctcggcctcccaaagtgctgggattacaggcgtgagccactttgcccggccgcttttcttttcttttcttttcttttttttttttttttgagacagagtctcactctgtcgcctctggctggagtgcagtcgtgcgatctcagctcactgcaacctctgtgcctcctggattcaagcgattctcctgtctcagcctcctgaatagctgggattacaggagcccgcgaccacacccagctaatttttgtattttttttagtagagacgggttttcaccaagttggccaggctggtctcaaactcccgacctcaggtgatccacccgcctcggccccccaaagtgttgggattaaaggagtgagccaccgctccaggctcacccctttagaatctacttgctactctgagtaccttcttacaaatgcaattgcggtgcttctcacagattcatttaaaaaaaaaaaaaaaagaggccgggcgcggtggctcacgcctgtaatcccagcactttgggaggccgaggcgggcggatcacgaggtcaggagatcgagaccatcctggctaacacggtgaaaccccgtctctactaaaagcacaaaaaattagccgggcgtggtggcaggcgcctgtagtcccagctactcgggaggctgagccaggagagtgacgtgaacccaggaggcggagcttgcagtgagccaagattgcgccactgcactccaaagacttaaagtccaatgttaaaaaagggagaaaattacccaggatattttgtatcctgagtatacgttatatagagattggtggtggtggtgatttttgttgcatttgggagttgctatgaaagttgagggactaattttttttttctttttgcttaggcaaactcctgaaaactacttctcttcctattttcatgcagagaaacttaatttctccttgccttttctccccctgtggagttaaaaatagtatggatgcatttattttgtgtcaatttccattaggatgcctgcagatactaacagattcttcaaagtccaaaaagcaacctcagattttcacattggggtaagtggaaaatagaaggcccttgattcctattaactaacctgattgggtatcaccattgttttcattgctaataattgttttccaatgagaatatgaatatttttattttaatggaagttttatacctacagtaaattcataggcattagttcattcactactaaaatgtatacttctctgaactcagacacacaggccatttaacaggatacatgtgacataataaattaaagtgacatgaaaatgaaagtttcatctatttagaactgcagagaagatttcaggttgtcagattatatgttattactaagtcttggttattgaggttagtgcagtaaattgattgagtgcttcatttaaaatactaattgagcacctgtctgtaaacagcagttaggcaatatgggtgaatactaaaaaggtaactttggtaatattgggaatactaaaaatatatacagagagaacgagcacgaaagtttcattaaagaaaagtgtaatggaagacatttgacatatacataagaaaaactcattaataatgaaaagcaaccatacaagaaatttagagaagcagagtgccgagggagtgggggcggtgggaggcggtaagtgctaagcatcggtcccctcagcagtttgaatgattttatgaagcaggtaagattccttcataggaagctgagagagggtgagggtaagtggaggggcttggatgatcacagtatgaaaaaatgggaaaaatggaaggaagactattctattcaagaagacctaacagcaaagccatgctcatggaccagtgactaggccaatctgaccagagcagagatttcagatgggaaaaagcgtgaaaatcatattttagtagcgttggaaaatatctaagatttcatcagcaagtttcctggaagagattgagactggaaggttagtttgatttatcagtgtctagtaaagttgaaaacacacatacgatatgttctagtcaatgcttggcaggaaacagaatgagctctcaccctgggtaattgaggacaattcaataaaagaactatttaccaaaatgtgggcagggttaatggcaaccttaaaaagcaacaagggtagcaatagcaggggagcctgggggacttcattgctgcccccaggcctgaagaggcaaagagagggaatggtgatcagaactgcagaacacagggagaatagcaggggcagtaggagagctccttgacaggaggcctttggtggaggaatgcagccaacccacagaggcccagcaggacgggagccaggagaataaatgcccagatcacactctcctcccaccctctgctttcctgctggcatcttccagaggccaaatccaacaagaagtcagagggaaaggaaattcatggctagcagttcataaaggtcagcttcctggggccaatgcagggaggaagaaagagaagatcagaggagcaaatggaaaacatccagtataccacgtgacccacaattctgttacaggaccacaacactaccccaaaggtagccattgggtcagggtttctgcactatagtcccatctgggttgccagaaatatgttacaaggaaggggtcccgatctagaccccaagagagggttcttggatctcgcgcaacaaagaattcagggcgagttcgcagtgcaaagtgaaagcaagtttatcaagaaagtaaagaaataaaagaatggctactccatagagcagcccagagggctgctggttgcctgcttttatggttatttttgaggttatgctaaacaaggggtggattattcatgcctcccgtttttagactacattagggtcacttcctgacgctgccatggcatttgtaaactgtcatggcgctggtgggactgtagcagtgaggacgagcagaggtcactctcgttgccattttggttttggtgggttttggctggctcttttaccgcaagctgtgtttgtttgtttgtttgttttgagacggagtttcgctcttgttgcccaggctggagtgcaatggagcgatctcggctcaccgcaacctccgccttccgggttcaagcgattctcctgcctcagcctccggagtagctgggattacaggcatgcgccaccactcctggctaattttgtatttttagtagaaacggggtttctccatgttggtcgggctggtctccaactcccgacctcaggtgaggtctcccaaagtgctcggccttccaaagtgctcggccttccaaagtgctcggattacaggagtgagccaccgcgcccggccttactgcaaactgttttatcagcaaggtctttatgacctgtattttgtgctgacttcctatctcatcctgtaacttagaatgccttaaccttctgggaatgcattccagtaagtttcagctcattttacccagcttctatttaagatggagttgctctggttcacacgcctctgacaattctactctaaatttcacaccgtatagaaacttccacgtgtgcaaaaggacaagcacaaatattgtcttgcagcatcgtttttagtagctctaaattggggaaaaactgaatgttcatcaatacggggctacgtaaattgaggtgtattcattgatagaatgtagtgcagccattaaaatgaatgaactggatatatataagcatttgtgtgtgtttgtgcacgcgtgcacatgcatgttttagagggatacatgtagtatgacatactgaataaaaatatttaaaacacacagaaaaagcaattgtatattgtttctacctacatgttatgtaatagaagtataaaaacatgagtaaggccgggcacggtggctcacacctgtaatcccagcactttggaaggccgaggtgggtggatcacaaggtcaagagatggagaccatcctggccaacatggtgaaaccctgtctctactgaaaatacaaaaattagctgggcatggtggcacgtgcctgtagtcccagctactcgggaggctgaggcaggagaatcacttgaacccggcaggcggaggttgcagtgagctgagattgtgccactgcactccagcctggcaacagagccagactctgtctcaaaaaaaaaaaaaaaaaaaaagagtaaaagaatatatgaagtcgcctgtaatcccagcactttgggaggccgagtcaggcagatgacttgaggtcaggagttcgagaccagcctggccaacatggcgaaaccctgtctctactaaaaatacaaaaaaattagctgggcatggtggtgtgttcctgtaaccccagctactcaggaggctgaggcaagagaatcgctggaacccaggaggtggaagttgcagtgagctgagattgcaccactgcactccagtgtgggcaacagagcgagactctgtctcagaaaaaaaaaagaatacatgaaatcagagaaactcaaattgtgatagtagtttcttctggtgaaggaagaaaagagaatgatatcagggaagatgaaaaaagagactgtattagtaaggcttctccagagagaaagaatcaacaggatcaatggatgcataggtagatagatagatagatagatagatagatagatagatagatagatagacagacagacagacagacagacagacagatgagaggggatttattagaggaattagctcaagtgatatggaggctgaaaaatctcatgacagtccatctgcaagctggagacccagggacactaggagcatggctcagtccaggtctaaaagccaaaaaaccagggaaactgatggtgtaattatccatcccaggtggaaggcctgagaacctggagtgcccctggtataagtcccagagtacaaagacaggagagcctggagttctgacttccaagggcagaagaatgtgtcgcagctccaggagagagagagaaagaatttctttcctccgccttttgattctatctgggggccccaaggcaatcggatcgtgcccgcccacatggagggcatatcttccctcctttatccagcaactcacacaccagtctcctctggaaacactcccactgatacacccagaagtaatgccttaccagctatctaggtatcacttaatccagtcaagttgacacgtaaaattaagcgtcacaggggccttcaactgtattgcttatttcagaaagatctgaggcaaatatgacaagtctagtgatactgctatgaagggggaaaaaggcagaggaaggagatggggaatcatggtggatgacatttaaaatctaggaagaatgattacaagaatccctcctggggaggggatatcagcgcagagacctaaatgaggggagggtagagatgcaaacatccaggggaccaatactccaagctgagggagcggcaggtacagacactaaggggtatcctgtttggctcatgactgcagtcccagcactttgggaggctggagcaggagaattgcttgagcccaagaattgaagaccagcctgggcaacatagcaagaccctgtctctacaattaaaaaaaaattagccaggcattgtggtacatgcctgtaatcccagctactcaagaaactgaggcaggaagatcatttcagctcaaggggttgaggctgcagtgagccaagatcacagcactgcactccagtgtgggtgacagagcaagaacctgtctcttaaaaaaaaaagtgtatatatatggaaaaaaatatatttatataaggagaatatatatatatttccatatatatatttatataaggagaatatgtatattctctaaaaatatatatgtttttccttatatctgaaaaaatatatatatatactccctaaaaaggaattccctgcattttaaaactgaaatatatataaatgttttatatacataacattacatttatatttttatatatatatatatatatatagtgttctgtttatgttgttgttgttgttgttttgagacagagtctcactctattgcccaggatggaatgcactggtgcgatctctgctcactacaacctctgcctcctgggttcaagcaattctcccgcctcagcctcctgagtagctgggattacaggcacatgccaccatgcccggctaatttttgtatttttaatagagatggggtttcaccttattggccaggctggtctcgaactcctgacctcaagtgatccacccaccttgacctcccagagtgctaggattacaggcgtgagccaccacacccagcgtaaagtgttctgttttaagtgaacaatccagcatatttagtatattaacaatgttgtacaaccacaatctctaattccaaaacatttcaatcactataaaatgaatcactctgtgcccataagcactttctccccatttcttcctctccccaacccctggaaaccaccaacctgcattctgtctgtatacatatacctttcgtgactatttgatataaatggaatcatacaatatgatctttgtgtctggcttctttgacttagcataatattttgaggtttatctatatacgttgtagcaaataccagcacttcattcctttttatggttgtgtgatactccatgtacatatatttgcagtcataatattaaaaaatttttaattgtggtaaaatcacataacaaaatttactatattaatcattttaagtgtacggttcagtggcattagtaatgtacattcatgttgtttacaaccatcaccaccatccacctccagaaccttattcttcactccaaactgaaactccatatccattattattgttattattattattattattttattattactattttttgagatggagttttgctcttattgcccaggctggagcgcaatggcacaatctcggctcaccgcaacctccacctcccgggttcaagcgattctcctgcctcagcctcccaagtagctgggattacaggcatgcaccaccatgtccagctaattttgcagttttagtagagacagggtttctccatgttggtcaggctggtctcgaactcccgacctcaggtgatctgcccgcctcggcctcccaaagtgctgggattacaggcgtgagccaccgcgcccggccccaaaactccatacccattaaacaataactcccaattgtcccctccctcagcccccggcaaccaccattctaatttctgtctgtatgaatttgactattccaggtacttcatataagtggaatcatacagtatttgcctttttgtgactggcttatttcatttagcataatgtcctcaaggctcatccgtgttgtattatgtgtcagaattttcttcctttttaaggataatatttcattccaaatgtatagaccacattttgtttatcattcatctgttgatgagcacttaggctgcttctacgtcttggctattgtgaataatgttgctatgaacatgggtgtaccaatatttgttcaggagtctgctttcaattctttttctttttttgagacagggtcttgctctgtcgcccaggctggagtggagagcagtggtgccatcacagttaatcgcagcctctacctcctgggctcaagtgatcctcccactttggcctcccacgtagctgggatcaccagtgcacacctcaatgctttgctaactttttaaaaatgtttttgtggagatggggttttgccatgttggccaggctggtctcaaactcctgggctcaaatgatctcctgcctaggtctcccaaagtgttgggattacaggcatgagccaccatgcctagcctgctttcaatccttttggtatatatccagaggtgggattgctggatcatataataattctacttttgattttttttgaagaatcattatgctgttttccataatggctgcattattttacattcctagcaacaatgtgaagtcttggtttgtgtgtgtgtgtgtctgtgttgttttttttgagatgatgtctcgttctgtcacccaggctggagtgcagtggcgccatcttgccttactgcaacctccacctcccgggttcaagtgattctccagcctctcagcctcccgagaagctgggatgacaggcacgtgccacaatacctggctgtttttgtatttttagtagagatggggtttcaccatgtttgccaggctggtcgcgaattcctgacttcaggtgatccactgcctcagcctcccaaagtgctgggattacaggtgtgagccactgcgcccagccaagtcttggtattttaatgttccccaattcagtgtgtgtggagagtactgggcagctctggagtggacattcacctgcatgttatctgatgggtctctctccttggttcaagagtgcaaggccaggtagtaagccagatgtggcttatgtaagtgattaattttatgtgtcaacttgactgggaacttagtgttgaatgtgatgcccagattaaacattatttctaggtgtgtctggaactcggtactaccaccttactccccaggtggtctgggagaggcagcaacagaaagtagacagtttattagggacccagcagatgctggaagcccagggaagggagtttcagggccctgcatccccctacctgtccccacaaatgcaccagctgctaagaccacacctcagcctccttcaccggacctctaaccccccaactatctcttcctgtggttggtcagtctatccacataggtgatgttatttgtccagctggcatctacaattcatcagtcagaaccttggtgatgacctgtccagagtggcaaggggtccaggcagatgagggtgtttccagatgagatgagcatttgaattggtaaactcagaaaagtactttgccctccccagtgtggatggacaccgtccaatttgttgagagcctaaacagaacaaaaggtaacaaaataaggaattcacctccccccactttttttgttgttgttgttgttcctgtctcactgcttgagcagggacatctcatttcttcttctcctgctctcagactgggatttatgccatcagctcccctggttcttaggcctttggaaatggatggaattatactactggctttcctggggctctagctggcagatggtagattacgagacttctcagccttcataactgcatgagccaattccttatcatctatctacctatctataagtccctttggttctgtttctctagaaaatcctaatataggacaggtgtagtggctcatgcctataatcctagcacattggaaggtcgaggcaggcagattacccgagctcaggagtttgagaccagcctgggcaacatggcaaaaccctatctctacaaaaaaaaaaaaaaatgcaaatattagccaggcatagtggcatgtacctgtggtcccagctactcaagagactgaggtgggaggatcacttgagcccaggaggttgaggctatagtgagtcatgatcacgccactgcattccagcctgggcaacagagccagaccctgtctcaaaaataaataaataaataagaaaatcctaatataccaggtgttcattataagtagctagggggttgggacaggaaaataaagaagttggtggtgcaggaagaggcttggagtcagggatcaaggggctatttgagggcttggactaggcttatgcctccaagaatggaaaagggatggaagcaagagacattaggatatggctaggatcaaaaaatcagatgataggccgggtgcaatggcttacgcctgtaatcctaacactttcggaggctgaggcgggcagatgatgaggtcaggagttggagaacagcctggccaacatggtgaaaccccgtctctactaaaaatacaaaaattagctgggcgtgattgcatgcgcctgtagtcacagttactcgggaggctgaggcaggagaattgcttgaacccgggaggcagacgttgtagtgagccgagatcacgccactgtactccagcctgggcaacagagtgagactctctctcaaaaaaaaaaaaaaaattagatgataacaaatagtgtaaaggatgtggagaaatcagttcccccacacattgttggcagaaatgtaaaatggtgctttggaaaatattctgacagttctgaaacaattaaatgtacagttactctatggcagggcatggtggctcacgcctgtaattccagcattttgggaggccaaggtgattggatcacctgaggtcaagagtttgagaccagtctggccaacgtggtaaaaccccgtctctactaaaaatacaaaaattagccaacatggtggtgcgcacctgtagtcccagttactcgggaggctgaagcaggaggatcgcttgaacctgggaggcagaggttgtggtgagctgagatctcgccactgcacccagcctgagtgacagagcgagactctgtctcaaaaaaaatatatatatatagatagatagatagatagatagatagatagatagatagatgatagatacgcagttactctgtgacccaacaattccactcctaggtgtatacccaaaagaaatgaggacacatgtctacccaaaaacttgtacataaatgtttacagtagcattatccatgatagccaaaaggtagaaagaacccaaatgtccatcaactgatgaatgaataatcaaaatgtggtatgtccataaatgaaatactattcaaccataaaaaggaatggagtactgataacatgctacaacacagacaaatcttgaaaacattatgctaagtgaaagaagccagtcacaaaatgccacatattatatgattctatttatacgaaatgtctagaacagggaggtctatagagacagaaagtagattttcagttgcttaaggctggagatggggtgacatggggatcttaagatgataccccaaatgttctaaaactgattgtggtgatgattgcatgtatctatgaatatactaaaaaccactgaaccatacactttattatttttattttttttgagatggagtttttgttcttgttgcccaggctggagtgcaatggcacaatctcagctcactgcaacctccgtcacctgggttcaagtgattctcttgcgctagcctcccgagtagctgggattacaggcatgtgccaccacacctggctaattttgtattttcagtagagacggggtttctccgtgttggtcaggctggtctcgaacttgtaaactcaggtgatccgcccacctcggcctcccaaagtgctgggattacaggcatgagccaccacactcagcctgaatcgtacactttaaatggtgaattgtgtggtgtgtgaattgtatctcaataaagctgttaaagggacagaagtctgggcacagtggctcgcgactgtaattccagcactttgggaggccgaggtgggcggatcacgagctcagttttttttgtttgtttgttttgagacggagtctccctctgtcgcccaggctggagtgcagtggcgcgatctctgctcactgcaagctccgcctcccgagttcacgccattctcctgcctcagcctccggagtgggattacaagcgaccgccaccacgcccggctaattttgtttttgtttttgtttttgtttttttggtatttttggtagagacggggtttcaccgtgttagccaggatgatctcggatctcctgacctcgtgatccgcccacctcgggcttccgaagtgctgggattacaggcgtgagccaccgcgcctggccacgaggtcaggatttcgagaccagcctggccaacacagtgaaaccccatctctactaaaaatacaaagattagccaggcatggtggcaggcgcctgtagtcccagctacttgggaggctgaggcaggagaatcgcttgaacccgggaggctgaggttgtggtgagccaagatcacgtcactgcactccagcctgggcaacagagcgagactccctctcaaaaaatagaaataaacgggacagaagccaggcgtggtggctcacgcctgtaatcccagcactttgggaggccgaggcgggtggatcacctgaggtcaggagttcgagaccagcctggccaaggtggtgaaacccccatctctactaaaaatacaaaaattagccaggcgtggttgtgggcacctttagtcccagctactcgggagtctgaggcaggagaattgctcaaacctgggaggctgaggcaggagaattgctcaaacccgggaggcagaggttgcagtgagctgagatcgcaccgcggcactccaacccggcgacagagggagactccgtctcaaaaaaaaaaaaaaaaaaaaaaacaaaatggacagaagatgtagcttagacttcatgagtgactagttatgggggctagagagaggaaggagacaaagagaacgtcaactattcagttcattatgacatggagaatgtgacggtaatcaccactgatagaaacaggacaatatgtggaaactgaaagaaataaaaatgcagtttggaggaagagatctaataaggttaaggaaaaatactagggccctgtaagttatttttgggttgattagaattttactagctttcccctacaaactccaagaaaatgtctttttcatatattttcatatctcatgggcctatattaagtcatgatcctggaccaaatgctgactccatctaggtatggcagagaagctaagcatccctcagtttccacactgtcctttttcctgttagcagagaaaccaatgctttcccccagttttcactgagaaaatggccacttcccagtttcctctgttggctggatatgtccatataactaagttcagcccaatgggatgggagggagagcgatgtgtgcaacttctagatcatcatcttaaagacaaaactttttgcagtgaatactctttttgctcttcctgaggactgaaacatgggctgagctagtctccatcacatgagcaggacagtgctttaggacaattggataaaagcgatccttattccttagtggcaggtggaagagaattgcttagctagccctggatatctgaccactagctgttttgtggtactcagaaatgaatttccattttatttaaaccactattttcaggtctctttgttaccatagttcggcctctaccgaaattaatacaccagtggggaatgggatgagcttgatgctagtgggccagggaaggtccctaaacgctggtgggaccacaaccctggctggtgtccaggctcttgacaccatcacaagaaggaattcaagaatgagtcagaaaatagtgaaagtgtggagatttattgcaaaatgaaaagtacacactcaagaaagtggagtgagggcgtactcaacagagagtcacgcaatggagtttggggtttctaaccttcatgggtttatttaaccgaggggtggaatattcatgaagattcctggaaaaaggtggagtttctcaaaactctggtgccactcatttttacaccaaatatgagtcctcctagaactgtcctggtgctggtaggtgtgtgattggtatgttaatgagtgtataatgaggtcctcagtgaaacctaggtcaaatccagtgccatgtttggtctggtaggtcttagccagctcagtccacatcctgtttttcagggttttatcagcccctcgcttctgtagctatttcatcagtttccttttgctagttatgtgaacctgcctcctggaattttctgttctcctgagaccaccctgtattaaggtgactgagtcaattcaatcagggtccacctctggggatggggccaggagaggggtcatcttccctgaagcacctgagttttatatggaacagtggacatctgaatgaaaactcaaggtgcttttccaaagaagaagggggaaaggatattgagcaatcaaaagcagaaaatgggccgggtgcagtgtctcacacctataatcccaacactttgggaggctgaggtgggcagatcacttgaggccaggagttcgagaccagcttggccaacatggccaaaccccgactctactaaaaacacaaaaattagccgggcatggtggtgcatgcctgttatctcagctacttgggaggctgaggcatgagaattgcttgaacctgggaggtggaggttgcagtgagccaagatcatgccactgcattatagtctgggcaaccgagtgagactcttttgcaaaagaaaaaaaaaaaagcagaaaaggttcactacaacctagaagagggtttctccacttaggcactactgtcatttggaactacataatattttgttgtaaggggctgtcttgtacattgtagaatgttggtagcatccctagtctctactgtatatactcccccccatcatgccaatcaaaaatatcttcagatcttgccaaatatcccctggagggcaaaaaatttcccatttgagaagcactgctctagaaagggcttggagctgccttttctgcctctcacttctagtctttttctcatatgattggcagattttcttttgtaacaaaaacatgccatgcttggaaataacaactgtattctgtgcactcatagagtcaaatctaaacccttaaatgagacttacaaaactcttctcaaaacaattacttgtctcacttctcaaaaaaattatttgtctcaactacaatcctatccccccatacagattgctctagtcatactgaatttttcccactattctcaaagtttccatgacttttttactcatatgcttttgtacatattcttctttctgcctgcagtacagacgctgctctacttgtgatgggggtaaatcttagtaagcgcattgtaagttgaaaatactggaagtcagccgggtacgggtggctcacgcctgtaatcccagcactttgggaggctgaggtgggcaaatcatgaggtcaggagattgagaccatcctggccaacatggtaataccccatctctactaaaaatgcaaaaattagctgggcgtggtggcgcatgcctgtaatcccagctactcaggaggctgaggcaggagaattgcttgaaccagggagtcagaggttgcggtgagctgagatcgtgctactgcattccagcctggcgacagagtgagactctgtctcaaaaaaaaaaaaaaaagaacgaaagaaaatactctaagtcaaaatgcatttactacacctaacctaccaaacattatagcctagtctaacctacctcaacgtgctcagaactcttacattagcctacagttggaaaaagtcatctaacacaaagcctattttatattaaagtgttgaatagttcatgtaatttattgactactgtactgaaagtggaaacagaacggttgtatgggtactcaaagtatgaattctactaaatttaaatcacttttgcaccactgtaaagtgaaaaaaaatcataagttggggaccatctgtacttttctccacttctctcttagggaaactcctatatactcttttttttttttttttgagacggagttttgctcttgttgcccaggctggagtgcaatggcacgatctcggctcaccacaacctccgcctcctgggttcaagcaattctcctgcctcagcctcccgagtagctgagattacaggcatgcaccactacgcctggctaattttgtatttttagtacagatggggtttctccatgttgaggctggtctcagactcctgacttcaggtgatctgcccgcctcagcctcccaaagtgctgggattacaggcgtgagccaccgcgcccagcctggaaacttctatatactctttaagactcaattcaaacaggacttcccctattaaaaaaaaaagtcctaacatttcctaagaaaacttggtgtctccatactaaactttgttcatacctatcgggtcatgcttggcacacttttttgttatttgtgtattaatcgcttttcagcccccgggggttctaacaaggtgcctaacacagagaagttgccccataaatgcttgttgaatgggtgagtgaaatgaaggaaaagtgccacagcagtgccttcaaatttcactgacaaaacttgtactttggccagagttcattggcttttattagcttagactgggtttacaacaggtgtctctgtcactaaactggaaagtaggtgaaaagctaacctcaggacaccaaattaaatactttcagcactgtgccatggtagcccttggatcacagagcatgaagtgtctgagcagtaatttccagctgctgctgccagagaaataataaatgatgttacacagaaagtatcacattatagtttattatacatgaacctctgtgagagtaagctgtaaatggttcgcaccctagagcatgggcttagtctttccaaacaaatccatttacttgttatctttataaagtcctgattaaaacatgttttggagatatagatatatctaacacatggaccatagtagtctcttgtgagtatctgaatcaaaattttagtatctagatagcaccaaacttagaaaagtatgcccttttacagaattacaggttcaatttcatttggctggactacatgtctttctactttagggtcctaatgtcagaatatggtcggacatggtagctcacacctgtaatcccaggactttgggaggccaagatgggaggattccttgaggccaggagtttgagaccaccctggacaacaaagtgagaccccatctctacagaaaataaaaaatttgccagggttggtgtatgtgcctgtagtcctagacgctcacaaggccaagatgggaggattgcttgaactcaggaagttgaggccgcagtgagccatgagtacatcactgcactccagcttgggtgacagagcaaaaccttgcctcaaaaaaaaaaaaaaaaaaaaaagaaatatatcagaataggcccactaccccctagaaaatgtccccaaacggcctctgctgcttcctactgctggctgtcttctcacatcactgacagaatcatctgtctattaacccagatatgtcatgcttggaactgtggagtctgtttaggacagcacaatcccgcagttgggtctgagaatagtaaaaatgtcacaaatgatccaccaactttggtggaatttttttttttttgagacagagtctcgctctgtcgcccaggctggagtgcagtggcgtgatctcggcttactgcaagctctgcctcccgggttctcaccattctcctgcctcagcctcccgagtagctgggactacaggcacacgccaccacgcccagctaattttttgtatttttagtagagacggggtttcaccatgttggccaggatggtctccatctcttgacctcgtgatccgcccaccttggcctcccaaagtgctgggattatagacgtgagccaccatgcccggctggtggagtttttttaacctaaaaattttacttctgtattaactttatagcacaaatattttcttcataatacggataatccagagggaagttcaaaagtgaaacagatggaggaagggcaggggaaaagatggtcccttgaattggggagagtagaaggtctcagggtccccatgtcatggcttccctgtgctggtccagtggatctcaactcggcggtctacacagcagcacacctggggaatttaaaaaatactgatgctccggccctgattgaaccagaatttcaggggacggcctatacagctactgcttaaatatccatccatgtatccagagtctgaaaaaaaccttcagattcataaacacagagcccatccccatgttggagaagcagagcacggtgatagcccccaccatgaataccaagaccggggagggactgggcttttccgccatctcctcactgtcccatacgctaccctcaacaaaaacacaggatagtgttaacagaagaaaggggaaggacactgggcaggtgcaaaaacatgacaaatatttattacagttagtataactgtgcctaaggcttaaagttccgtggtttgttttttttttgagacagagttttgcccttgttgcccaagctggagtacaatggcacgatctcagctcactgcaacctccacctcccgggttcaagcgattctcctgccttagcctcccgagtagctgggattacaggcgcatgccaccacacccggctaattttttgtattttttgtagaaacgggatttcaccatgttagccaagctgctcttgaactcctgacctcaggtgatctgcccacctcagcctcccaaagcactgggattacaggcatgagccgccgtgcccagtcaaggcttaaagttcatacaccaggcctgaacagcaattacttgctgcctaagtctttttttttttgagacagtcttgttctgtcgcccaagctagagtgccaatggcatgatctcagttcactgcaacctccacctcccagattcaggcgattctcctgcctcagcctcccaaggagctgggactacaggcatgtgccaccacacctggctactttttttatttttagtagagatggagtttcaccatgtttgtcaggctggtgttgaactcctgacctcaaatgatctgcccacctcggcctcccaaagtgctgggattacaggcatgagccattgtgtccagactttttttttttttttttttttttgagacagagtctccctttatcccccagtctggagtgcagtggcatgatctcggctcactgtagcttccgcctcccgtgtccaagcaattctcctgcctcagcctcccaagtagctgggattacaggcacatgccaccatgcccagctaatttttgtatttttagtagagatggggtttcaccatgttggccaggctggtcttgaacccctgacctcaggtgatctgcccgccttgccctcccaaagtgctgggattacaggcgtgagccactgcgcccagccgctgcctaagtcctattatagttcaggacctgggcaaagttgaacttgaacctataagtaaacaaggctagggaatgcaggatacaatacaggtagcagtaaaaggtgcgggcatgttttcttagctttgagtgaaggggaaaaaaattgagagggaaattcccccccccttttttttctgttaatgttgatatcttataatgttggacactttaaagtaaatacttataatcctcacccccacagaaaagtttcacttgtgttatataacatatacccaatagaattgagatatgattcataacctatatgtgtgactctgtttcttaatcataaaatgtgtggtatctgtcaatgttagaagatggagcagggactcctcttagggacctgccaggtgcccccacccccaccaccacaagcacgaaaataaaggacaagttttgagttccttcacaggagattccaggcacctagctagacttgagaagtaaatgagcaatccaagaagagagcagtaggtggggcgtggtgctcacgcctgtaatcccagcactttgggaggccgaggcgggtggatcacgaagtcaggagatcgagaccatcctggctaacacggtgaaaccccgtctctactaaaaatacaaaaaattagccaggcgtggtggcgggcgcctgtaatcccagctactcaggaggctgaggcaggagaatggcgtgaacctgggaggcggagctggcagtgagccgagatcaccccactgcactccagcctgggcgacagaatgagactctgtctcaaaaaaaaaaaaaaaagagagagcagtaacttaaaaaataagtcttctaagcaagttagagtcacaagctatttcagttgcctgtagaaactaaaagacaacatcttaatgtatgttcttgagttgttttttgtttgtttgtttgtttttgagatggagtctggctctgtcaccaggctggagtgcagtggcgtgatctcggctcattgcaacctctgcctcccgggttcaagccattctcctgcctcagcctcccaagtggctgggactacaggcacatgccaccacgcccgggtaatttttatatttttagtagagacagggaatcaccatgttggccaggatggtctcgatttcttgacctcatgatccgcccgccttggcctcccaaagtgctgggattacaggggtgagccaccgtgcctgttctttgagttgtttatcagaaagctggacccccaccagatgaaaaatgctgatcactgtcacatagacctcagataagggagaagtaaggactgaactctgactgttctgaatttctccctgagcagcctggagggagtcaggcccacaggccaaaccttaacattcctttccgatgacccccagtttttagacaaagccttgctccttaaccaactccaaatcaaagagtctctgaatccaattatgacctgtaagctcctgctttgagacatcccactttttggtggccaaatcaatgtataacctccatatattgatttactattttgcctgtaacttttgtttcctttttttgagacagagtctctctctgtcgcccaggctgcagtgcggtggtgcgatctcggctcactgcaactctgcctcccgggctcacgccattctcctgccttagcctcccaagtagctgggactacaggcacctgccaccatgcccggctaatttttttgtatttttggtagagacggagtttcaccgcattagccaggatggtcttgattttctgaccttgtgatccgcccacctcggcctccgaaagtgctggaattacaggcctgatccaccatgcccagcctctttttttttttttcccatttaaaaaatatttttggtcaggcacggtggctcatgcctataatcccagcactttgggaggctgaggtgggcagatcacctgaggtcaggagttcaaaaccagcctggccaacatggcaaaatcctgtctctactaaaaatacaaaaattagctgggcacggtggcacacacctgtattcacaactacttgggaagctgaggcaggagaatcacttgaacctgggaggcggaagctgcagtgagctgagatcatgccactgaaccccagtctgggcaacagaatatgactccgtctcaaaaaaaaaatatatatatatatatatatatattatatatatgtgtgtgtgtgtgtgtgtgtgtgtgtgtgtgtttgtgtgtgtatttatttatttatttttataaaaaatagagacagggtctcactatgtttcccaggctgatcttgaactgggctcaagctatcctcctgcttccgcttcccaaagtgctgggattacaggtgtgaaccacctggccaacttctgctttcttaaacatccttacctgtaagtcattagggagttcaagtcttcagcattagtttgctgcccagttctccttgcctggcaccaggcaataaatgcctcacttccgcttgctgtaaatcccagcgtcagtgtttgtttgtttgtttttcctgtgtgctgcgtaagcagacccaagttcagttgggtaacagctaggattctaaaggttaagggaagcaagtgaactttgttttggctttttcccactacaccagagataaaccagtacagggagtaaagtcccatttttacaggctgtatatgagaggacctgtgtgcagtgcagagcagctgctgctccgggtagaaaagtcttgcctaaagatcaaacaatcagtatgtcactatgagttctccttgacccaagagctcttgcaggcctggagggaacatctgtcccagagtggtctttatggagaatttctagggttggtccattagggaaaatgtccccaaggaacattgattcttacctatataagaatacatacacccaggccgggcgtggtggctcacgcctgtaatcccagcactttgggaggccaaggcgggcggatcacgaggtcaggagatcgagaccatcctggctaacacggtgaaagcctgtctctactaaaaatacaaaaaattagctgggcatggtggcgagcacctatagtcccagctacttgggaggctgaggcaggagaatggcgtgaacctgggaggcggagcttgcagtgagccgagactgcgccactgcactccagcctgggtgacagagtgagactctgtctcaaaaaaaaaaaaaaaaaagaatatatacacctcactccccatttttgtgagacctgagaaagcagtaaggacagtaatgacgatgaatagtgacttctttttatttctactatgcaggctctgtgctggatattttgcctgccatgatttatttaatcctgaacacaaccccgtgaggtagaaattagcaccagctcacttgggtgaactgagtctgtctgacctgcgtctttcagccatgtctctgaaacctactttttctgcagcaccccccaccctgaactagggtactgtaggctctaatttcttaatcgcctcagatcatccacaagttctgacacctgagattggagcccgtggtcttgcagacagatccccccggtaaccaagggctttctctttagccttcttccaatcacctgccaattgccttcccaatcctgcttggactgactctcagatgctacagtgacactgcttcagaggagtgacatatatatacatataattatatataaaataatatataaaaatagtatatataaacaagaaatatataaaaatatatatttcatttacttatttattttttgagatgaagtctcgctctgtcacccaggctggagtgcaatggtgcaatctcagctcactgcaacctccgccttctggattcaagtgattctcctgcctcagcctctcgagtagctgggactacagccatgcgccaccacgcccagctaatttttgtagttttagtagagacggggtttcaccatgttggccaggatggtctcgatctcttgacctcatgatctgcccaccttgtcctcccaaagtgctgggattataggcgtgagccagtgtgcccggcctatttcttttatttttatttttatttatttttattttttttagacagggtgttgctctgtcaccaaggctggagtgcagtgatgcaaacatgctcactgcagcctcaacctcctgggctcaaatgagcctcccaccttggcctcttgtgcagctgggactataggtgcgtgccaccatgcccagcaaattttcatatttttaattttatgtagaaacagagtctcactttgttgcccagctggtctcaaactcctggattcaagccatcctcccaccttggcctcccaaagtgctgagattcaggcatgagccactgcacctggcctcacaggcttatctcttggccttatcattttctccaaggtgaatgccaaagaaaattgactttgctatgcatttgagtcagtggcctctgcctgttcctgttggtatgcctgatttctggcctatcctggttgaagcttgggctctgtgattatgaaagagaagacttttcagacaccagacatatgattggatattaaaatagtggctagacaggattttatacctgtaagtgctatagcaaatgctccttctctcctgtcctcacacacaaaaaaagataaattatggatccttatcctttggaaggctggaagcttatgtgttaaaagtgtaaatgttagctgcgtgcaatggctcactgtaatcccagcatttaaaggccgaggtgggcgatagctttgagttcaggactttgagaccaacctgggcaacatggcaaaaccctgtctctacaaaaaatacaaaaattagctgggcgtgttggctacttggcccctatagtcccagctacttggaaggctcaggtgggaggtttgagcctgggaagcggagactgtagtgagatcgcgccactgcactccagcctgggtgacagagtgagagcttgtttcaaaaaaaaaaaaaatacacacacacacacacacacacacacacacacacacacacacacatatatatttggtgttataaatatttttaaagtaacttttatgttttttcgttttgtttttttgagacagagtcttgctcagtcgcccaggctggagtgcagtggcgcgatcttggctcactgcaagctccgcctcctgggttcacaccattctcctacctcagcctcccaagtagctgggactacaggcgtccgccaccacgcccagctaattttttgtgtatttttagtaaagatggggtttcaccgtgttagccaggatgatctcggtctcctgacctcgtgatccacccacctcggcctcccaaagtgctgggattacaggcgtgagccaccgcgcccggcctatgtttttctaattataaaaatatgtgagttttctgtagacagcatgtaaatacagaaaaatatcacccagagtccaataatccctaaatggagaatcactgggaacagtttagtgtatatagtatgtttaagctgtacatacacataaacacaaaattgtgagcattctcagtatggtttcatgtactgctatttcatttactattaccctgctagcatttcccctatcatcaaaattctttgaaaatatgtttattaactgtataatattttattttatgaatgtactgtgaattatttaatcctcttcagagactcaggttgattctactgataattgtgctgcaacgagcatactgtgcgttcatttctatgtggaattctatggccttaaaatagaatcctagcagtagaatcactgagataaagggtaagagtatctaaagcagtggctaatgaagttttagttttaggaccctttacattcttatgtgttttttcttttttttctttttttttgagactgagtcttgtttttttttcttttcttttttttgagactgaatcttgctctattgcccaggctggagtgcaatgacacgatctcagctcactgcaatctccaccttccgggttcacgccattcttgcgcctcagcctcccaagtagctgagattacaggtgcccgccaccatggcgggctaattttcatatttttagtagagacagggttttgccattcttggccaggctggtctcaggtgatctgaccacctcggcctctcaaagtgctgcccggccctttttcattctcaactattgttgaagacctaaagagattttgtttatgttggttacagctatcagtattcactatattagaaatttaaaataagaaattaaaaaaatatttattacttcatgttaaaatagcaataaggaacccattatttttgaataaacagaggaattaacgagaggttgaagtcaagtatgctagtttcctgcagaggcccaaagaaattcccgtttctggtgattccattcacagagactgaaaacagaggagcaggggagtgggcaggggtgggccttggtggagacagagatgggaaagagggtgagtctgtaagagtctggcattcctcctacaggacacgtgggcattttcaagactccagtccactaggtggatcttcaaaggcttatgccacattcttccatagcacacttctaaaatacctgttttatagggtttaaactatctgctttatagggaccaagtgtggtggctcacgcccgtaatcccagcactttgggaggccgaggcagatggatcacaaggtcaggtgttcgagaccagcctggccaagatggcaaaaccccgtctctactaaaaatacaaaaattagccggggccagatgcagtggctaacgcctgtaatctcagcactttgggaggccaaggcaggcggatcgcttgaggccagtagttcaagaccagcctggccaacacagtgaaacccagtctctactaaaaatacaaaaataagccaggcgtggtggcgtgaacctgtaattctagctactcgggatcctgaagcacgagaatcgctagaatccaggaggcagaggttgcagtgagccaagattgcaccactgcactccagcctgggcgacagagcaagactctatttcaaaaaaaaaaaaaatctgctttatagggtccttttacaaactattaggccacttatcctcaaaaccaaacaatgcaatagggtagacagataggaactcgcaggctgttcacaaggaaactgaggccctgagaggttatgtgacttgtcagtcttcccacctcccttttgcccatcttataatagactcatgtctggaactcaattgtcctgattgctagctcgttgtgcccagtgactcaagagagtgaaaattgttggttcagcagtctatcttctaaatttgcttcttctaaaagtatttaaaaggtataagaaatataaattactccctaggctgctaggcaggcacctggttttctcctggggtagtcagaaccctcctatctttaatttttcacggatgaatataccaacagtgaacaatggccagaccatggggaatagaactgagtctcacaaactttgtagcaaccagctggggaagccaaaccacttggcttccaactcagcaccgaccagagaaagccaaagatgctccccagactaatcaccgaagatgccctgcttcattttttttttttttttttttttgagacagagtttcgctttgtcacccaggctggagtgcagtggtgcgatcttggctcactgcaacctctgcctcccagattaaagcaattctcctgcctcagcctccctagcagctgggactacaggcacgcaccaccatgcccggcttatttatttatttatttatatttttagcagagacgaggtttccctatgttggccaggctggccttgaactcctgaccttgtgagcttcccacctcagcctcccaaattgctgggattacaggcgtgagccaccgcacccagcctgccctgcttctaagcagtccatctcccacttcctcgtgccaataagctccaatccagataaacctgaagccttccctttttgtcactgtaaattctctcactcctctgcctgctttgaccttctgccaaagtgatggaagctgactcccatagcatagcaagctctgagtaaatagcccctgtactcatttatttccacaccactgaatgaataatgaaagatgttataaagccaaattatgaaaagggcatcagttattaaacatttgtaaaatgttttacaaccatcttagtatgcctcataaacacctcgtgaagtgctgccatccccgtttcagagctgagaaaattgagaaggaaccatgagattaagtgacttgcccagagctatgatgagaacatgagccccccagggtttgaggtctgttgtttatccactgagcttgagctgcgctttggaatcattaccatcttaaagcattttaccctgtgttgggtgaatattaagaagtagatcacatttcagcctggcaggcgcgaaagtattgtttttagtttgtttttctaaattttagtagaggacatatgggctctattaactttactatgtagcacaatttgaaagatagtttcttttccagcaaatttttcaccgtaatttaacattttaaaattcagcacacaccgtcctccctggatacttgtttttctcagagttgggcctttttcctctccactgcagcttggaaggtcgtaaatccagccagggggattttattatgcctggggacagttttcaaagttaggtatgagtggaaggaagggagggcgggtgcaacagcgctggacaaagtccgtctaatgcaagactttcctttcttttttttttgtttttaaagataagaacttttttggctttctccccgcaaagcttgctgatgatgttgactgatgaggacatgaaaaaagctgagatttgcagaacataactggagcataagaacgcctgtctggaaggcaggggctgctgggaaaggatctctctggagctccttgctggctgcaaaaatgcagctgtccctattcctctctactctgggacatttaaaaaggaggctgtgtggcagtagcatttggcttgtgtgccactgtacctggtcagcctggcatggaatgccttagtggtttgttaggggtcactgactgaggctaaataaatttagcaccatgtatactttcattaaatattaaacaatgaggccaagcacggtggctcatgcctgtaatcccagcactttgggaggctgaggtgggaggatcgcttgtggccaggagtttgagaccagcctgggcgacatagcgaaaccctgtctctacaaaaaatttaaaaaattaactaggcatggtgatgcatacctgtagtcccagctacttgggaggctgaggcaggaggatcacttgaacccaggaggtcacggcagcattgagctctgatcatagcactgcctctggcctgggcaacagagcaatactctgtctctaaaagagaaaaacaaacaaacaacaacaaaaaaaaacacaaaaagacaataacattcaattgtttgctaatggttcatctgcccaatctctggaatcctgtctttcacctactcaccttcactcacttagaaacttatgcattggcttcaaatactatttcttctatattatcctttcacctttcttctttaaaaaaaaatttatttagagacagggtcttgctaggttgctcgggctggccttgaactcctggccttaagtgatcctcccacctctgccttccatctttttatcttcttcagcttatgaaaatggatccatctgcattaaaggcctaaaaatgtatgtagtcaggtgagtgttgtgatagttggtgtgatggttaatactgagtgtcaacttgattggattgagggatacaaagtatgaatcctgggtgtgtctgcgtggctattgccaaaagagattaatattggagtcagtgggctggggaaggcagatccacccttcatctggtgggcacaatgtaatcagctgccagtgaatataaggcaggcagaaaaacacgaaaaggagagagactggcctagcctcccagcctacatctttctcccatgctggatgcttcctgccctcaaacgtcggactccaggttcttcagttttgggacttggactggatctccttgctcctcagcttgcagacagcctattgtgggaccttgtgattgtggaggttaatacttaataaactccccttatgtctgtctgtctatctgtctgtctgtctatctatctatctatctatctatctatcataggatatatatatatatctatttatattagttctgtccctctaagagaaccctgactaacacagttggtgaaggtttccttttctcctctgatgatgtgagtgaagcaggctttcagggattatgagaacaggcgaagtcttcaaggagatgggcccctcaaacacagcctgcacatcccatccatctccccattctcctggaagccatgccttggaaggcagaggggatgctggagggatgcaggtctcagggcctgagaagttgagggtggttctagatagagtagagaatgaatgggataaggggcagtagaggcctgacctccgagagatctcaccactcctaactttgactattcctgtctggctgcatttgggtttccttttgtcccaagaaaagaaagacgaaaaaccttagagtgttgggagtctagatatgttaaaactaacagatgttagttcattgatcaccaagacaatgcacgggccagtaggacttctcacagcaaaaaagccaggatggagaggcggaagaccaggttgggcagatccttcagctttcagctgtttttctcatcctttatagcactgtaattaggactagatgaggaaaaaaagatgggcatgagctgtagctacagggggaaaacaataaatgactaacagataaaaaaaatgtaagtgaagtgctaatattccagtcatttaaaatattgctgggaagaccaattatccgtgtaaaaaaggtgaaaacaaatataacattgcttaggtaattctgtggacccttgatacacagtatttgcataaaatcagaattacagaatttagtgttttgtggtttttgtttgtttgttttttgagacacctgggtccggggaggtggaggctgcagtgagctgtcatgccactgcactccagcctgcacaacagagtgatgaaagaaaggaagggagggagggagggagggagggggaggggaggggaggggaaggggaagggagaagggagggggaggggaggagagggggaggggaggggagggggaggggaggaggggggggaggggggaggggaggagagggggaggggaggggggagggaggggagggagaaagaaaggaagggagggaggaggaggggagggggaggggagggggaggggaggggagggggaggggagggggaggggaagggagggggatgggaggggagaggagggggaggggagcgggatgggaggggaggggggagggaggggagggaagggagaaaggaaggaaggaaggaagggagagaaagcaagggaaagaaggaaagaaagaaagggaaaataatcaaaaatataagaacacaaacaaaagcacattctgtcagctcatcctctctataggctaaggaaactatactatctgaacccaaaggagagaaataaacaaaatcaaatacttatctacccatccctctgcacacggtcttagttgaagtgagagtatacacttcattactgtgtacctggattttatcccattctgctacaaaatgcacgtcagtgcgttcactttcactgcatgatatagaagctgttctgtatgcagccaaatcacattactgcccattgctgaaagaaatgaccttcaatgaacgggttataaaattcactcatgatcacttattgaatgcctatgtgccagacacactgttaagcatgatggaatcagagaaatgttgctgtctaacgtatcccagtctagtggggtaatatataacctgatacattatgattccatggaagtgtttcactaatggtataaatcacgagctgtgtcagaaacccaggaggaattgatacgtctcccgggagagtgtggggagactctggtggaggtgacgtgtgatcgtggtcttgaaggatgagcggaaatttgccaagtgaacaagggggaaaggaatttacaagtagagggaagaggatggctcgtcaaagtgtctggcaatactgagaaatgttgaaaagggtggtgtagctacagcccaggtttcacgggacagaggtagctgcagtgtggttaggttggggctagtgcatggggagccttggtacacctgccacgtgcaactggtaatcatccctagaggtactgggagcacagagtgtcatgcgtggagttacatgtactgtgtgctgtgcttttaatgtaacttgaagtcgtaaggagggaatatatgatgtgggagcagagcaaggagaagcaagttagggagaccaaacaggaggcagcagtggggacggctgactttgagaggcgtctttgaaagacaataggtaatatttggtagacattggatgtggaggctgaggcagcaggagaaacagagtatgactttgaagttgctcaatacaggagatactgggtggctggcggtactattaacccagatgacaggacacggaaacaggatgggttctctgctccggcgtgtccctgaggagtcactcttaactttggtacaggtgatcagcaactgggaaagtgtatgaagcccactccagaatgagaccactgacctcttcatttccatgctttcggctcaaggtatcattcggctcaacaccatttaaaagctatctaggctgggtgtagtggctcacacctgtaatcccagcactttgggaggccgaggcgggtggatcacttgaggtcaggagttcaagaccagcctggccaacatggtgaaaccccatctctacaaaaaaattaaaaaattagctgggtgtggtggtgggtgcctgtaatcccagctacttgggagtctgaggcaggagaattgcttgaacccgggaggcagaggttgcagtgagctgagatcgtgccactgcactccagcctgggtgacagagcaagatgccgtctaaaaaccaaaataaaaagctatctaggggcaggcttatgcctgtaatctcgacactttgggaggctgaggcgggcagatcacctgaggtctggagttcaagaccagcctggccaacatggtgaaaccccatctcctttactaaaaatacaaaattagctggccatggtagtgcacacccataatcccagctactcaggaggctgaggcaggagaatcgcttgaacccaggagcagaggttgcaatgagccaagatcatgccattgcactccagcctgggcgacaagagaaaactctgtctctaaataaataaataaaaataaaagctatttagggccaggcatggtggctcatgcctgtaatcccagcacttcagaaggctgaaatgggcagattgcttgagtccaggggtttgagaccagcctggccaacatggcaaaaccctgtatctacaaaaatacaaaaattagctgggcgtggtggcacatgcctgtagtcccagctacttggggggctgaggcaggaggattacttgagcccgagagttggaggctgcagtaagctgtgtttgcgccactacactccagcctgggtgacaaagcaaaattgtctcaaacaacaacaacaaaaacaacaacaaaaagctttctagaacatttccaatctagtgcaaacctctttttggttacaccgtgtatcattccagttataagaatgtaaaaagtggcaactccggagccaggctatctgggcaagtgacctctggaaaggcccttaaacttcgctgtgtctcagtttccttatctacagaataaggattaaaattattcaaaaggttgttgtggaattgaaatgagttagtatatgtaaaagtgaatctggcgcatagtgtaagtactttcttttgtggagtcttgctctgtcgctcaggctggagtgcaggggtgcaatcttggctcactacaaactctgcccccgccacgcccagctaatttttgtatttttagtagagatggggtttcgtcatgttggccaggctggtttcgaactcctgacctcaggtgatccacccgcctcggcctcccaaagtgctgggattacaggcgtgagccactgtgcccggcccatagtgtaagtactttctaagtgtttgctatcaataagtaataaatcatagaatactcgactgaaagtggtacaaatattagagatttattattacagaacaagatggaagttggcagttccagggtttgtcctgtcaattaaccaaggcatcccggagactggactcttcctgtacccactgccacgctcagtgtggcagtgccttctcccctcatcatggcagggaggccaccacagctccaacaaccaagtcttcacatggtcagcatcccaagcatgaaataaggggatgtggttagaaagggcttttctccttgtgcagccttccctttacaagcaagaaaatctctcctagaagtccctagtaggtttcctttcagctaaaacttgggtcacaggcccatccctgaacctggcacttccaacctgtaacaaatgaggcagaagtgggactagggctggctgctgggcagctgaccggtagtgcccaccacagtctgggagccaaagagttccaaaagttcctcactcaggccaggggtaattgagaaacaggcacataacagtattcatccaggagtcctcaggttttttaagagttttttagttttttttttgttgttgttgttttgtttttttttttgagatgggctctcgttctgtcgcccaggctggagtgcagtggcgtgatcatggctcactgcagcctcgacctcctgggctcaagtgatcctcccacctcagtctcccaaagggctgagattacagatgtgagccactatgtgcctggctaagagtagcttatttttattttattttattttatttttttgagatagagtcttgctctgtcgcctaggctggagtgcaatggagcgatcttggctcactgcaaccgccccctcccggcctcaagcaattatcctacctcagcctcccaagtagctgggattacaggtgtctgccaccatgcctggctaatttttgtatttctgtagagatggggtttcaccatgttggccaggctggtctagaactcctgacctcaggtgatccacccaccttggactcccaaagtgctgggattacaggcgtgagccaccacgcctggccaagagtagctttttaacctaggtcagtatcgtgttggtaaaatacggagagaggatgtttgagcagaaggacctacctcatcttctcacctgttctaggctgctaccttctctttctacaaaccaaaggagggggctcataactcaatgggccttgtgggaaaggctaaccagactagtcactgctgaattcctctaagggattcccctaccctgactgcccttgccacagttgcacccaccatcctaggggcagtaagtagagagagctgtgtgagaagagcactctttccactccagatgtcccctacaacctatatcctcacggccactaacagtttgggcccgtagcatcactcatctggaccgctcccatgtggtctccccatcacaacaaagactgcagcaaggtggacagagaactccaagagagccaggaaaatacctttataaaccatcacagaaagcctgatttccactcgctaaatccattaataaagagaggagaaattttaaaattccaaggcacctggttactaatctgattctggcctacatgtggatattcaataaatacttgttaagttaaattgactcaaggttttatttattcagcctacttaaagcttatgtaaaccccttggagatttgtgtcaagctgttaagttggaaaatataagaaaagtagtattttcaatagaccagctttcctcttaatgtactttatgaacttagtgtaaaccagggaaatgggggaggggtaccagaagagcagaggggaaggaggtgaggaggaaggaagaggtgaggaggaaggagaagaaaagccttttctgtcatttcctgcatttgtcttaattgctgtacttattaaccagctactgccctctagtgctcactgtattaagttcgcatctgaattccatttttatctttaaaaactctggtgacacttggaagggatcaaatttcctgttttgcagataagcaaattgaagtccagaggaaagaggtatcaaactgacccaggggacttctggactctttgttacctcacctataacttgtctggaaaactttattaaaagcctttctcagaaattttaattggtaaccagtaaaaattgtagcatcatgttagtgctagttattattattattatttttgagacggagtctggctctgttgcccaggctggagcgcaatggtgcaatctggctcaccgcaacctccgcctcctggattcaaactactctcctgcctcagcctcccaagtagctggaactacaggcgcccgccaccacgcccggctaattttttgtatttttagtagaggcggggtttcaccgtgttagccaggatggtctcgatctcctgacctcgtgatttgcccatctcggcctcccaaagtgctgggattacaggcgtgagccaccgcgcctggcctgtgctagttattatttccaatgttgttctaaattaagcttagactgattgctggtcaatttaagtaaggatataaaataatagtggtacatttttaacttagtacaagtttagaaaatgtctataatacttctttaaaaagttaactagaggccgggcacggtggctcacgcctgtaatcccagcactttgggaggccgaggcgggcggatcacaaggtcaggagatcgagaccatcctgactaacacagtgaaaccccgtctttactaaaaatataaaaaattagctgggcgtgttggcgggcgcctgtagtcccagctacttgggaggctgaggcaggagaatggcgggaacccaggaggcggagctggcagtgagccgagatcgcgccactgcactctagcctgggtgacagagcaagactctgtcacacacacacacacacacacacacacacacacacacacacaagttaactagaacagatcccaagtggatatggccatttatcagaactgacttatcattgtctccatgtgggctaacattccgctagattctcccaagtgaagctctttgctcactgatgggaaaaagggggggttgtcattttaacgtggaacgcatattttcaccacataatcattttgctagtggaaataaatggaaagttatccagctggacatgctacttatgagaacactactgagtaacaaaagatttattcaaatatttaattggaaggaactacatctggaataagttttaaaggaatccatataaaaagaaaagcaaatccattagaaattgatataaacagttgattttatctggaaccaagaatgtgaatgaattggaacctagatgtcctaacctgtttctttgcataaaagccagttgaattttgaaatttatatggcaattatactttattactttacatagagctttgtttttagctaatattttagagacagattacccaaaattacctaatttggttcccacttcattccttctcaaaaaccaaacataaaacagaagggggccagctgtggtggctcatgcctgtaatcccagcactttgggaggccgaggagggtggatcactaggtcaggagtttgagaccagcctgaccaacatggtgaaaccccgtctctactaaaaatacaaaaatcacccaggtgtggtggcacatgcctgtaatcccagatacttaggaggctgaggcaggagaatcgcttgaacccaggagacggaggttgcggtgagagccgagatcgtgctactgcactccagcctgggcaacaaagcaagactctgtctccaaaaaaaaaaaaggaaagcagaagggggcattttcctgtcttcaaaatacaacctcctgctaagactagcaagtcagcagaaactcattgcatttgggcttctggttactaaatgaattaagagacaccgagttccatccttagatgtccacatagatcccattgatcaaataatccagtcttgagtaacgtttcctgcggagtgattccgagaggattctacccaggaggacgaggcctatcaccaggaacaggacaccaaagagcagggacccgataagaagccatttttcaaatggaaggccgtactgattttctggaacactgccctgggaggaactgcctggactggcctccctaccttcccaggaagcagttttattcatagtggaagactccacatttgacatagaaagtgcagtagggttatacacattccctgtgttcaaagttaggttggagatttctgtaaacggtatggtttctaagctgcctttcgagtccgtaggtgcctgaaaggtggtagtcagaactgctgttgtagccattgcttggagtgtagccgcagcccgtgtaaaaactgtagaaatgagggtcgtgggaggctgagaagtgacagtggttacaggtggagctgtggtggccagctgtggctgggaagtcccagaaggtgtcactgaagcattggtgggtagaagggtggcgggctttggagtagccgaggtggtatgtggagaagcaactgccaccgtagctgggagcgcactcacattttcaggcagcagatgagctatttcttgatcagaggaaaattgtgaactctgagaatggcctttttccttataagcaaggagctgggcacttgcttcatccatcttaaatagtttctccaagtgatctgaggatccaaacttctgagaaagtgtgtctctccatgagatatcggtgggctttgaataatctgtgtgatgatgggctaggggagtgactgcttgtgaaaattggccatgtaagagagaatcttcctggggtaactcttggcttggcaaatttctggtcaaagatggaaaatctgaaaatgtatggaaaataaaaggaaggcttatgtaactccatgctacggtaggttaaaaaaatacaaacatatcagcttgttcaaaagatccctaaactggttggccatggtggctcacgcctataatcccagcactttgggaggctaaggcaggaggatggtttgaggccaggagttggagaccagcctggacaacatagggagatcctgtctcttaaacaaaaaaatctccaaactgttgatacttgacatttcattgaaatgtgtgcaaaatggaaaaacacaaattgctaaatgagaatctgataacgccgcctctctaccagatgctgtggtttatttctagcatgataggacagaagagaagagaaatgtgtggaggaggaccaggcaaattaaggaaaaggtgggaggtgcacagcagagaagccggaggggctcagcagggcagcaagaggcttacaaagatggaaagggttctccgtcttcctaaggggccaaggccagggaaaaaagtgggccggagggtgacctgagcaggaaaggttggcagggagaatgcgggggaaggtgtgggcttctgcaagacatgccacctaagactgagatgacaaatggggagcaagtaatcatcaggagagatttcagtgggggcatgaggcaggcaagaaaggtatgtggaagctgtgggaaatgaggcaatagagcaggagagagggagcagaatccctgtggtgtgtctctgacagggaggaggaggaggggccaggcagggtctggtctccgctctgagcactgaggccacagcagcagcagaacagcaacaacgacaacaaaaaaccagagatatatcgttccagcactgtgcgcagaggagggaggctatctgggagatttcatttggactctcaaagattagaattttggagccaatgtcataggtcatgaggatgatgggaccaatatttgaaatcatgatgaccacactgtagacacagagggcagaaaaaccatacagtcccgatgcctgctgaggagaaaccagccccagatcctgctcctgctccatgaagcttagaatttttctcctgatcacacaccccatttatcacagctcaaactggaaagacctgttcaagcaatcaagtgcagggaatgaccaggtgaattgccatgtatcactctgctgctaggctaaccatctcacattagaactgcagaaaacacaaggaaagaagcagaggaatgtcctggcatttctcagtccactcactcctgctctcttttcctttttcttcctcaattcacctccatgccagtttccaaactggtcctcagtctcctctttcctacagacggatccagaggcagctacggattcatgccatctcgtgactactctctaagccttacccctctgagaggttctttgcactgtcactctgtcacttattcgtccatctaggacagggctcagcaaactacggcctgatggacaaatctggcctgccatctgtctttgtatgacttgcaagctaagaatggtttttacgttttttaaaatttttatttgttttgagacagagtctcactctgtcgcccaggctggagtgcagtggtatgatctcgactcactgcaacctctgccttccagattcaggcgattctcctacctctgcctcctgagtagctgggattacaggcgcgtgccaccacacctgggtgattgttctatttttagtagaggtgaggtttcaccatgttggccaagctggtttcaaactcctgacctcaggtgatccacccccttcggtctcccaaagtgctgggattatagaggtgagccaccatgcctggccagtttttatatttcttttaatggctgaaaaataatcaaaagaaaattgtgtgacacaggaaaggtatacaaaattcaaatttctgtatttcaaaacctaaagtactggtgtgaaaagcctaaaatactatttggcccttggcagaaaaagttggtggacatctgctctaggatatagtattctactctaaagtagaatttgggtcaaatgaaatatatttgaaaatatatatatatatatttttgagacagggtcttgctctgtcacccaggctggagtgcagtggcacaaacacagctcactgcagcctcaacctcctgggttcaagcaatcctcccacctcagcctcttgagcagctggggccacaatgccatgccaccatgcccagctaatttttgtattttttgtagagacagaattttgccatgttgcccaggctggtcttgaactcctggaatcaagcaatccgcccacctcagcctcccaaagtgctggaattacaggtgtgagccatcatacttggcctataattcattttaaagttaaaaaagaaaaagactgtttaagtaaacactctgtgatgtgtgtgaaatcagaacttaaatatggccattgacaagaatggccaaaacagctgttttctttctcaagcatgcaagctcataaataaagcaaagctagggccagtcccacttcttgataagattcctctgttggcagaggtcctagaaccacaaagggatcctccacacctgctccattcgcctcacccactcatgtttgccattggggcatggtgcttcctctcagtcacgcagagatgagccacaaagggagctgcaaagcagctcagcgcccttaactcctctttggagttttattttcaaacgacttcactgagttgaaaaatgagagactgactattactgggaccccagctgagcaaacagactcccaatttattctatgtctgaattctcctattcttccagtccttggtaaaaatgacatgccatgaagctgccaacaacaacaataaaagattaaataccaaactgcaatggctttagagaatgaacagaatccactgtcatctttcaaactcttggtccgtaaatattagtcaatgggatataggaaatagaggctgggcacggtggctcatgcctgtaatcccagcactttgagaggccgaggcaggatgattgcttgaggccaggagtttgagaccagcctgggcaacatactgagacccccccattgctacaaaacattttaaaaaattagcctggcatggtggtgcattatctgtagtcccaaatacttgggaggctgaatggagaggactgcttgagctcaggaggtggaggctgcagtgagccatgatcgcgccgctgcagtgagccatgatcgcgccactgcactgcagcctgggcaacagagtgagatgctgccttaaaaaaaaagaaaaaaaaaaagagagagagagacagaaaagaaaaagaaatagagttcttccagaaacaaaccaccaaacagataatctgtatttaatttcactccaggcaggaggcagataattcatttttaatggggtaatatgaattcatcaacatggacagattcatacacagaattacaaacacaacttgcacacatcctgtagatataaacagtcctttgcatactatgtccggggttggtgccacgttgcccctaggtgtccatcaacctgctcaggggccggcaacgccccctggtggctgccacaagaacagtttaattctaatttcacttcattaccttcacactcgccctaaaaagatttatgcacatgccaagttcccttttttccgttcccattggcaaggaacttcatcccatacatgctcttttatatgtgcattacaaaagtaacaacactccagaagtattagaaaacaaattcagctgtaatttctatcatcgtatcctaacaacaattatttacacaatactctgtgcttcacgctcctgtttgagaggatgtttgacccatcaggcttccctggcacatgaacaaaactcagacacagcctcagctagggggcaaagcagtgtcaacacgcaggcaccctgggcagtatcattccccgaagcccctcatacttaatgcagtcaagagagaaccctagattccactccacctagattccattccacaaccctaaaactactcaagtttcccccagtgcagcaaatggtgtcaccattcatctggatgctcaaggcaaaaactaggacttggccttgatggttctttttttctggttccccagacccacaccaccagcaagtcctgtcaactctacttcggaatagcccatatgtccactactctctccatctcgcccgccactccctgtttcttcacccagatctcacctgcgcctcctaaccagtctttccatttccactttgctgctgtgtcactgtccattcccaagagggcggctacggtgagctttgagaaatcaccttttttttttcttctccccgagacagagtcttgctctgtcgtgcaggctagagtgcagtggcgcaatctcagctcactgcaacctctgcctcctgggttcaagcaattctcccgcctcagcctcctgagtagctgggattacaggcacgcaccagcacacccggctaatttttgtatttttagtagagacggggtttcaccatgttggccaggctggtctcgaattcctgacgttgtgatctgcccgcctcagcctcccaaagtgctgggattacatacatgagtcaggaggtcaggaatttgagaccagcctggccaacatggcgagaccatgtctactaaaaatacaaaaattagccaggcatggtgatgcttgcctgtagtcccagctactcaggaggctgaggcaggagaatcacttgaacttgggaggcagaggtggcactgaaccgacactgcatcactgaactccagcctgggtgaaaagagtgagactccatctcaaaaaaaaaataaaaataaaactcccaacagcttcccaccacacacctaaaaactcccggccgggcacggaggctcatgcctgtaatcccagcactttgagaggccgaggtgggtggattacccgacatcaggagttcgagaccagcctggccaatgtggtgaaaccctatctctactaaaaatacaaaaattagccacgtgtagtggcatatgcccctcctaaggcggaggttgcagtgagctgagatcgcgccactgcactccaccctgggcaacagagtgagactctgtctcaaaaacaacaacaacaaacaaaaaaactccctcctatgacttacaaggtgttatgtgatctggccctccccaccgttttgcatatcactctctgcgtatttcacaatgagtcaaccagctgggattggagtgttggtttttcaaacactccaaagcattctgcctgaggaccttggacttggaaggtcttcccctgatctcctcacatctggctcctcactattcagatctcagtttaggggttacaactttacttactgattgtctattataccgtcctgtctcaattctgtgcatagcacttgtgactatatttttcttgattatttatttattatggttattgtctctctcccctaaaacataagttccagaagggagaaccttgttttcctattttttttttagagatagtatctcactttgtcacccaggctagagtgtagtggcatgaacacagctcactgcagctttgacctcctggtctcaaggaattctcctgccttggcctcccaagtagctgggactacaagctcatgccaccatgcccggctaatttttttaattttttgtggatatgaggtctcatcatgttgcccaggctggtctctaacttctgggctcaagtgatcctcccacctcccagagtgctggaattataggcatgagctaccacatggccagaaccttgtttttcatgtttagtgttgtttccttagggcatagaaagtacttggcacataggagatgctaaataatatttgttatttattgaacaaatgaacaagtagaatattaaaaatcaagagtatgatgataactttctaaaacttaaataaaagaaaaattgaagctgggtgtagtggctcacgcctgtaatcccagcactttgggaggctaaggagggtggatcacctgaggtcaggaggtgagaccagcctggcccacatggtgaaaccccatctctactaaaaatacaaaaaaaaaaaaatagctgggcatggtagtgggtgcctgtaaccccagctacttgggaggctgaggcatgagaattgcttgaagccaggaggtggtggttgcagtgagctgagatcgcaccactgcactccagcctgggcgacagagtgagactctctctcaaaaaacaacaacactcatgcctgtaatcccagcactttgggaggccaaggcaggcggatcacgaggtcaggagattgagaccatcctggctaacacggtgaaaccccatctctactaaaagtacaaaaacaaaattagccgggcgtggtggcgggcacctgtagtcccagttactcaggaggctgaggcgggagaatggcctgaacccgggaggcggagcttgcagtgagccgagatcgcaccactgcactccatcctgggcaacagagtgagactccatctcggaaaaagcaaacaaacaagcaacaacaacaacaaaccccactaaattctgtaattctgattttatgcaaatactgtctatgaagggtccacagaattacctaagcaacattaatttgttttcaccttttttatatggataatctcaaaaaaaagaaaaattgatactgaaaccacttcaacttgaaaaattaacaagccaaagtctcagcaaaacatatcccaggaattatattaatttttttgctatttattttccattctgaattaatatgtaagttccatgaacatggagattgtagttctagtgctttggacagaatctggcacatggtaaatgtttaataaatatttcttgaatgaatttcctttccagtctagacaataaaatccagtgagtttgatttcagacgagattgggtgcgttcagggtggtatggccataaaaagtttgatttcagataatgtgattataatgggaacttaataacaaatatactagaactttctatattaacacaagtcttcaccctttcaaaacaatcaccctggagacctgtatacttattccagtgttgccgaccttgttctaaagaggtgcttcaaaaacgtttcatacaaggtttgtgtgtcttttatctcatgaaggtaaaaacagaaacaaaccagaacaaatactaccatggctttcattggaaatcaaattttggtttaataaattgaatttccagtcatgagattttctgatatgtctggtaccccttctggtagttttatttagactcttgtagaaaatctttcacatgaaccagtcttaaattattccaatcacaaaagaaaaagtataatgctttcattacctgtaattatcctgtaactcataagtccttttgctggtttcaatggacaggcttcctcgttgggacagaaaaataggtagcagttgggttgtctagctgtttttcgagtgtcgaagatcatcaagttacatgctttgtcccctgcaatgaaaggtttcataagcatgattttgaaatgcgattttctaaagagtagggcaagtaggaaaaacttcacttattatggagtccaacacaaacacctttgttcattttgttcacttgcttgctgaccgctgaatcatttccttttccttagcttagttgcttaaggcaattttaaaaaacattgggtttagctttttttttttcacaaggtggcaccgaaggcgaagaaggaagctcctgtccctcctaaagtcaaagccaaagcaaagtctttaaaggccaagaaggcagggctgaaaggcatccacaaccacacacacacaaacacacacacacacacacacacacacacccctaagacctgcatgtcacttacctccagcagctcaagacactgtggctccagaggcagcccgagtatcccgggaagagtgctcccacatgtttgaccactctgccatcatcaagccctgactactgatgtgctatgaagatagaagacaaccacacactggtgttcactgtggatgccagggccggcaagcaccaaagaggctgtgaagaggctctctgacactgatgtggccaaggttacaccctgagcaggcctgatggagagaaagaggcatgcgctctgctggcccctgcccacaatgctttgcatgttgcctacaaaactgggattatttattttttttattttttattttttgagataatgtcttgctctgtcgctcaagctgaagtgcaaatgcagtggcatgatttcagctcactgcaacctccacctcccaggttcaagagatcctcccacttcagcctcccgagtaactgggactacagatgcaagccaccacactcggattttttttggtattttttgtagagatggagtctctctatattgcccaggctagtcttgaactcctgggctcaagctgtttgccctagttggcctctgaaagtgctgggattacaggtgtaagccactgcacctggccatctcttggattctgaaagcatctcagatgcctaataaagccatgagtggagtcagtaaattatcatagatatcatggctccttccacacaggatctgagtagtatatggaatacagtctatcttttaatttttatctgtaccattctttgtgtttttcttccaattacccctctctccttgtcatatttgcttttctatgttccttccttccttacttttcactgttaactataatttctggtctcttttcttttcttttttgagtcagggtcttgctctgtcatccaagctgcagtgcagtggaacaatcatggctcacttcagccttgacctcctgggctcaaacaatcctcccacctcagcctccccagtagctgggacttcaagcgtgcaccaccatgcctggctaattttttgttttttgtagaggcggggtctcactatgttgcctaggctgatcttgaactcttgggctcaagcaatccatccccctcaacctcccaaagtactgggattacaggcatgagctaatgcacccagctgctggcttctttttctgttcctcttgtgtccaacagaaattaaaccctctattcatcatggcctagatttgattttgtcctccatttggtacagtctcacatctttgggaggtcagcgtatccctggtcaggctgaaggttaagagacacataggctaattgttaaaaacatacgctctgtcgaccatcaccaccactggtgctagtcaggcaatggtgagagatcaactccaactcccgagatgggaaggaagatttagttagcctctgcaggagttttatcacgtcatatccccattactcagataataacaggagtactcctgcttttcctttctcaacaatgtgataccagaaatacctttctttttagcacttaggtaaaggggagggtccataagctcaaaattgtatgcaagatattgtgcccatcgtgttatgtgcatttttctagagtatcatcgagttatcatagtgccttttgaaccctcggtggttaaaccatttctcaggaagtgaggaaaatgtttgagatccattaactgaggttccaagtacctctgcttgtagcaaagcagtaataggactttggcttctagaataaaacagcaaaccctcgtttcttagaattgaggagcagggctttgctgatgcctgtaaataccacacttacagtattcagtcctgcttgcaggtgatgtttctatttcacatacatgttgatgtcaacatttaaagaaaaactagaaatttaaattaaacctctgtcatttccataaattacttgcataaagtgtcccaaagcacactgctcaatgagaccatcgaagggatttttcctcctgaccccaagtatacggtgtcttctccacaccattttgcagcaataaccacatatcctactattgagttcaattctgacaccaactatccagagctggcatcagattccatggattatgggctcggtatcacaagactgccctcatttcagaagccagtagcaagtatcaggtctccaggtcacccacacttctgcctgactcggctactgctaattcagggattcccatgatcctaccccctcagatttgataatttgcaagaacaactaatagaactaaggaaaatgctgtatttactattacagtttataataagggatacaaatgaacagccaaaagaggctcctagagtcccaagtgcaggagactttgtccctggggaactgaggtgcataattctcttgacactgggatgtgttcaccaacttggatgcttcccgatcatctaggggtttttatgatggtctcattttacacaagcatgattgattaagtcatgggccactgtgactgaactcaatctccagtccctcccctgaggtgaagcctcactagcacaaactcaagtatagttgaaaggggctggttatgaataaccaaagacatgctcccatctcttgggaaattccaaggtttttaggagttctgtgccaggaactggagacaaagatcaaatatgtatcttttgagacaaggtcttgctttgtcacccaggctggagtgcagtggttcgatcaaagctcactgtaggctgggtgcggtggctcacacactttgggaggccagcactttgggaggccaaggtgggaggatcatttgaagtcaggagttcaagactagcctgaccaacatggtgaaaccacgtctctattgaaaatagtaaaaattagctggatgtggtggcgaacacctgtaatctcagctacccgggaggctgaggcaggagaatcacttgaacctgggaggcagagaatgcagtgagccaagattgcgccactgcgctccgtccggcctgggcaacagagtgagacatcatcacagacaaacaaacaaaaaagtccactgcagcctcaaccccctaggatcaagtgatcctcccacctcagcctcccaatagctgggactacatgcgtgcaccagcacgcctggctgattttttactttttacagagaacagggtcttgctatgttgcccaggctgctctcaaactcctgggctcaagcaatcctcctgccttggcctctcaaagttctgggattacaggaatgattcaccacacccggccattcactagcttttctaggcaacttgatggcaaggccttgtccatcttattcactgttttctctctggcaactaacaaagtgttaagtactcaagaaatttagtttttttcatttagagaactcggacagggtcataagtaaaattgaaaaaaggttttactaaaatacacagtatacttctcttttcagtacaaatacttaaatcctaaaatatgcaagtcctggttcaaacctatgggtctcagtttcctcctgtgtcatgaaaatgggccagactaattgattccccatcccattagagttctagaagctgtagttacctagtagtcagtgtttttttgttttttttttttttttttttttttgacttatcctatgccaccagctccaaggaaggagacgaagtggaggttttatgcttccaacttaaagatcaaatgctgattttcccaagagataagaattctattttttgtctcaaccccttttctctgtttacattttctttgtaatatcacactgtattccaatactccatgctgatggcagctaaccatttcaataggatttttgttttcaatattctagataccagttgggatataacaccagtgattctcaacctcttgtctacccagtcacctgagggatatatacatacattcatcaataactttgactcagcttaggagaggggagggcacacttgtagaaaattctccagtgattttgtcacttatattcataccctgtcgagaatcactggtataagttattcagccacatcccccagctcctgaagccacaaaacacatggaacaaaggattgccaagaaaccactatttacctgatatgttttttgttgaacagcaagaattaatgcagtcttcttgagttgaagtatatacgggctcattgcctctgattcccttagaaagagatgactggatgtcaatgacaacatcttctagactctttttgaggcaattctgactagcagacagccttagtgtcaggaagcaaattattaccaaagtgtaagtcaagctcccttctcccccgaagaacattttaaatttcagtttagttttggtcttcaaaggtcaaggataatcctccctctggtcttagtttgctttaagaaggctgcacagatgatgagatttctctctagaacaaaaatggaaaatcatcaatgagttttgtttctttaacaaacaagggaagaaacatttcatttccttaaagtcaatgaaaaggatccacatacaatttagagaagaaaagatacacgtattttttgtttcacttttagtaaatttaagacaacttttcattaaacatttggcaaagaactaataagcataaacaaacatactacctcaccaatgcttaaaagctgacaatgcttatgaaggaacaggtataaacagtaggcctgcctcggaattctacaatccttccctcttctaactcagagcggagagggcacacatttctagtcactgatgaagcagtagtaataggtttgagcatatttcctttctcagtaataacaatcagcattttaaaatcatctactaggggctaggcgtggtagctcatgcctgtaatctcagcactttggaaggctgaggtgggtggattgcttgagctcaggagttcaaaaccagcctgggcaacatggtgaaaccctgtctctactaaaaatacaaaaaattagctgggtgtggtggcgcatgcctgtggtcccagcgacttgggaggctgaggtgggaggatcgctggagcccaggaagttgaggctgcagtgagccgtgattacaccactgcactccagcctgggtgacaaagcgagaccatgtctcaaaaaaaacttaaaaagtaaaaataggtgacaatatactagatggtagacattgtgctaaggaatttaccactcttttgaattgttattctctttaatttattaccatctttaatctttataccaactgtaatggctaatactgagtgtcaacttgatttgattaaaggatacaaagtattgattccgggtgtgtctgtgagcatgttgccaaaggagattaacatttgagtcagtgggctgggaaaggcagacccaccctgaatctgggtgggcacaaccaaatctgctgccagtgcagttagaatataagcaggcagaaaatgcgaaaaagagagactggcctggcctcccagcctatatctttttttttttttttgagacagagtattgctgtcgccaggctggagtgcagtggcacaatctcggctcactgtaacctccacctcttgggttcgagtgattcccctgcctcagccttccgagtagctgggactacagacgcatgccaccacgcccggctggttttttgtatttttagtagagacggggtttcactgtgttggccaggatgatctcgatctcctgaccatgatccgcctgcctcggcctcccaaagtgctgggattacaggtgtgagccaccacgcccagccccagcctatatctttctcttgagctggatgcttcctgccttcaaacatcagactccaagttcttcagttttgaaactccttgctcctcagcctgcagatggcctattgtggggccttgtgatcatgtgagttaatacttaataaactcccatatatatatatatatatatatatatatatatatatatatatatatatatattacactagttctgtccttctagagaaccctgactaatacaacaaccttgcaaaaaagctattattggccgggtgcggtggctcatgcctgtaatcccagcactttgggaggtcaagtcacgtgggcggatcacctgaggtcaggagttcgacaccagcctggccaatgtggtgaaaccccatctctattaaaaatacaaaaattagttgggtgtgatggcgggcagctgtaatcccagctactcgggaggttgaggcaggagaatcacttgaacccgggaagtggaggttgcagcaagccacgattgcaccactgcactccagcctgggtgacaagagcaaaactccgtctcaaaaaaaaaaaaaaaagctattattttcctcattttataatgaagaaactgagatagtctttcctattgctgcttctccttaagaagtatcaaatcagagttagaaaactctaataatctaattctagaaattagccagtcagcaggaggaatacgctgcctcagttaaaggaaagtttaggggcaggttttctttttgacagccttaaaaatacaaaagtcacactatgtataatgccaactctattgagatgctggttcttttaggaaaaataaatgttaaactggcaagacaatacaagaaattatcctcacctatcaacctccacatttccttttaacatttcattaaacattttgttgaatacaaattgtttgctgaatgatagcttagagcagaattactacttctttaacctttgtttattaacccctttgatagtctgaggaagctcaggatctcttttgtgagacatatttaaaaatgcataaaatggaatatgtaggattccaaaggaagccagttatagtgaaatataattaccaaaatagattttagaatgtccctacaaaatcctggtgaaagaaatcaaagaggagctaataaatagagagatataacatgttcatggataggaagactttattttgttaacatatcagtgcttcctggccaggcgccatggctcaagcctgtaatcccagcactttgggaggccgaggcaggcagatcatgaggtcaggagatcacaaccatcctggctaacacggtgaaaccccgtctctactaaaaatacaaaaagttagctgggcgtggtggcggccgcctgtagtcccagctactcgggaggctgaggcaggagaatggcatgaaccccaggcggagcttgcagcaagccgagattgcgccactgcactgcagcctgggcgacagagcgagactccgtctcaaaaaaaaaaaggtatcagtgcttcccaacttgagctacagattaaatacagtcttaatcaaaagcccaaagttattttttggatatcaaccaactgattttaaaatttacatggaaatgcagaaaagaccaagaacagtccagaatactaaagaacaaagttggaagactgatactacctgacttcaacacttaccgtaaagctacaataatcaaaaaagtatggtattagaaaaagaatagacaaacagatcaatggaatggaatagtaaacccagaaatagaccctcacaaagagagtcaactgatctttgacaaaggagcaaaggggattcaatggagaaaggacagtcttttccaaaaatggtactggaacaactggatatccatttgcaaaaatgaataaataaataaatctagccacatactttacacctttcacaaaatttagctctaaatggatcacagacctaaatgtaaaatataaaaccataaaatttctagaaaataacagaagaaaatccttgtgaccttagattaggtgatgagtttttaaatacaataccaaaagcacactccatgaaagaaaaatttgatgttggacttcattaaatttaaaaacttctgctctacaaaagataccgttaaagagaatgaaaagataaaccacagacttggaggaaatatttgaggtggtttttttttttttggaggaaatatttgtgaaacacacatctgataaagcagcagtccatagcctttctcgcaccagggaccagtttcatggaagacaatttttccatggacggcgttgtgggggtatggttcaggatgattcaagtgcattgtatttattgtgcactttatttctattattacattataatatataacgacataattatacaactcaacataatgtagaatcagtgggagccctgagcttgtcttcctgcaactagacagtaccatctgggggtgatgggagacagtgacagatcatcaggcattagattctcataaggagtgtgcagcctagatccctcacatgtgcagttcacaacagggttcgtgcgccgatgagaatctacggccaccactgatctgacaggaggtggagctcaggcagtaatgcataatgtaaatacagaggaagctttgctctctggcccactgctcacctcctgctgtgtggcccatttcctaataggtactggtctgcggcccaggggttggggaaccctgtgataaaggactggtatccaaaatatacaaagaactcaagtcagcaataagaaaagaaactcaatggacagaagatctgagcagacaccttatcaaagaagatatacagatgacaaataagcatatgaaaaggtatctaacatcatatgtcattaggggattgcaaattcaaacaagataccactacccacctatgagaatggctaaaatccaaaaaatggacaataccaaatacaaggacatggagcaacagaaattctcgcctgggcgcggtggctcacatctgtaatcccagcactttgggaggccaaggtgggcagatcacttgaggtcaggagtttgagatcagcctgaccaacatggtgaaaccccatctctactaaaaaaaaatacaaaaattagccagatatggtggcaggtgcctgtaatcccagctacttgggaggctgaggcagaagaatcgcttgaacccgggacgtggaggttgcagtgagccgagatcatgccactgcactccagcctgggcaacagagtgagaccctatctcaaaaaagaaaaaaaaaaaaggaaaaattctcattcattgctgttggggaatgcaaaatggtacagccactttgggagaagtttggcagtttcttaccaagctaaatgcagccttaccatacaattcagcaattgtcctcctatgtattcactcaaatgaattgaaaacttatgtccacacaaaaatctgcaatagaatatttgtagtagctttattcataattgccaaaaactaaaagcaaccaagatgcccatcaatagatgaataaacaaaatgagatacatccatacattggaatattactcagtaataaaaataaatgaactatcaagccacaaaaagacatggaggaatcttaactgcatattcctaagtcaaagaagccagtctgaacagatatgaatctaactgtatgacgttctaaaaaaggcaaactacagcggcagtaagaaggccagtggtcaccaggagaacaggagtgggaggatgaatcggtggagtgcaagggatatttggggcattgagactattctgtataacactgtaatggaggatacatgttattgaacatctgtcaaaacccatagaaatgtaaaacacacagagtgaacattatgtgaactatggacttttagttttaaaaaaaggtaaaaccaaaaaaaaaaaaaaacccagaaacaaaccagtatatggtaataaaacacaagtctaatacttttcttgctgtttgtcaaaattctgtatacagtaaaatagtaacatttattgcgtctaaaatgccagtttctatgctaagcactttatatatatcatgtcatttaatctttacagatcccattattatcctcattttagttaaaacttacaaaaagttgtgggacataatatgtgcttctttattaacctattaagtaacaagtggtcatctaataactgccataattttgacgtggtattgagtatagataatattttgaaacgtgcaacaagtcatgtgatataaagatatcggcaatatttacagggggcaaatcatagctactgctaatactactgtggcttttgcctacattccatttcagaagtcggtgaaataataattttttccactcaagttcacagacatcctgaattctatccatggataccttatcgtggactccccaggttaataattctggccaaggtacttaatacgctgccatattttgcaagcctctagggaatcaagagaaaaccaggccaatactttattttgaatggattctaatgtagcctcttttcaagcttttgcaaagaaacctgaactatgtaaggagatggggcaggagttgttttcagtatgcagcattgagagaagtgtttaagagttttatatcattaaagaggctcagcaatattaggttagcgacgttttctaatccattattatttaggctttaagggcctgaagtcgagttgaatcttgttgaaagacggggtaaaaggatacaggcgggtgagagaggatgcccctgagttttaacgtctgcatacaagagtcgctaaaacttactcgcacgtaattagttcaaatattggaaatcgtcttacagcacactataatttaccaagatgcttataactgtatacacacacacactctacagagaattagacaattagcagtttcaataatgaatacagagtcaacgacaagaaaacagggaacattttctcttcctttgaggaaatgcatgttgcctactgagctattcttctgcctctccttctgatgtcaacgcagagccagagccatttatggcaggtgccttgagcccgcctagaggtcccctttggaatactgcagcgactcaaggatcctggtcagcccttattggccccagctggtcctttggatgctcgggtgtgggtgaaggagcctcggcccctggaaaggaggggaccgactctctccgcaggtagcgacgtcgcctgcggccggtcgggggtgggtattggggagacccctttacctggcgtcgagaggaccccggcgcccctgctgccatccaggtgcgaggacagctctgtcgcgcccgcgggaaggaccggcgaatccgcgcgggggtctcggcgaggaccgcagcggatgctccgcagctcccgcaccggcctggcgggttttgtggttagcaagttcctgcttccgtcgcagcgacggcaagtttgccgcgggggaagggcacgttcctgccctgcaacccggagctgcttcccggcaacattagcgcgtccctccccgcggaggctccgggctcccggccccagcgctgagccccgcagggaggtggctccccccaccgccccgcgctcccccccagctcagccacaccgctgaccccgggctgggcgcgctgcgagggggagtgcgtgcctccctgctggtggcccgagggtctgcaggtgagccttgcctcgcggcccgcgcaagttaaaataaatgcacatggggaaaatgtcaaacagtacaaaaatagacacagagacaagtctacccctcacccccgtgccccagtctcctagtctccctcctcagaggcaaccactgagagcagttttttgatgttcaagggcttatagtgcatcctattgggggcatagttctgagaatcctctttccataattggaggatggagtcctcaattaaagatggcaattcttgagttaaatattatctgcaagacaaacttcagggaaggtatttggctttctgcgggatttattgtttgtagataggataataatggtgaaaatgctggtgtctgtaacatatattaaaactgtatccctaacacttagcatagtgcctggtacacaataggtgctcagtaaatatttaactaaaatatttttgttgactgaatgaatggaaaagaactgcatagggcataggttgtggaagtttctaaattactgctggccccatccccacctccataaacacacacacaaatgcaacgttactaaaccattgacacttagtttgccatatggtctaacctttgacagtatcttcacctctgttttgaaagagcttgcagacctgaagcgctatgcaattgcaagttaagtctaggcctgtacggccaacagctacacaccctagtcttaaccaataactacaggaggattaggttgactgagaatgcttgtgaacaaaggtccattgtgtgaaactaactctacttgtaaccaaaggatgactcttgaattacaatgttgctaaagctaggtttgaaagagttaccaaagaaaagtaaacaccagagtaatttcccattgcagtgattttcctgatgcaacaagggactgatctgcaagtgtgttttatcttttatcatctgatacacttcagggttcagggtgtagagctatcacagtttttgaatctctctacatggggtaatccatgctagttacaaagtagacctttccattattagaaacttcgtattcggtgctttaatacaatgaacctgtttctttttttgttttgttttgtgttttgtttgtttttagagacggagtctcgctgtgttgcccaggctggagtgcagtggtgtgatctcggctcactgcaacctccacctcccgggttatagcaattcttttgcctcagactcctgagtagctgggactacaggcacatgccgccacgcccagctaatttttttctattttagtagagatggggtttcaccgtgttgcccaggctggtctcgaactcctgagctcaggcaatccgcccgcctcggcgtcccaaagtgctaggattacaggcgtgagccactgtgcccggcctgaacctgttttcattgaagtgatatgttattttttcagttatgacagtgaacaaaggatattgattaaaataatgattaaagaaatattttctattatatatgtttaatttataaatatcattgtttatttattcatttttttagacagggtctcgctctgttgcccacactggagtgcaatggcacaatcacgactcactgcagctttgaccacctgggctcaagtgattcttttgcctcagtctcttgagtagctgggaccacaaacgcacaccacacccagctaatgttcttaattttttttttttttttaattttgagatggagtctcgctctgttgcccaggctggagtgcagtggcacgatctcagctcactgcaacttctgcctcccaggttcaagcaattctcctgcttcagtctcctgagtagctgagattacaggctcatgccaccatgcccagctaatttttgtatttttagtagagtcggggtttcaccatgttggtcaggctggtcttgaactcctgacatcaagtgatctgcccaccttggcctcccaaagtgctgggattataggcgtgacccaccgtacccggtgttttaaattatttgtatagatgaggtcttgctacattgcccaggctagtctcaaactcctgggctcaagcaatcctcctgctttggcctcccaaagtgctgggattacaggtgtgagccactgcacttggcttacttaaaaataaaataaaaactttaatttctggcctgagtcataacttagaaattatatccattgtcacttcatttcctgaagagattcttgacactcttctctgagggttagaagtcccatctatgtggagaaagatttctttaaaagtaatcggaaaacatgtattaagcagccaggcgcagtggctcacgcctgtaatcccagcactttgggaggccgaggcgggtggatcacgaggtcaggagatcgagaccatcctggctaacatggtgaaaccctgtctctaataaaaatacaaaaaattagctgggtatggtggcgcgcgcctgtagtcccagctattggggaggctgaggcagaagaatggtgtgaacccaggaggtggagcttgtagtgagccgagatcgagccactgcactccagcctgggtgaaagagtgagactctgtctcaaaaaacaaacaaacaaacaaacaaacaaacaaaaaaaaaaacatgtattaagcacctgcaggggaaactaaagaccagtaataccaatgagatctacctttaagatgttcatagttcagaaggagaaaaagtaaatcaatggctgtgtaaacagttaagtgtgatgaaggccaggtgtagtggctcatgcctgtaattccagtgctttgggaagccaaggcaggaggatcacttaagcccaggagtttgaggccagcctgagcagcatagcaagactccatctctacaaaaaataaaaattagcatggtgtggtggtacacgtctgtagtttcagctacttgggaggctgagacaggaggatctcctaagagcctaggaggctcttaggaggctgtagtgagccatgatagcatcactgcactccagcctgggcaacagagtgagaccctgtccctgccctccccaagaaaagaataaatgttatgatagaagatggcaactaaaaaggctcagagaagggacatctgatcccaatttctgggaagaggtgttaattattgaagaatgaagttattagcagatgaggaggaaaaggctgaatatttcaggaataggaaactgcatgaccacaggaaattcagcctgttaggaaggttaccagtgtacacagaagaatagagagagaggctggggtcagagcaggaaggttttcatatgttaaatcttaaactttatcctaaaggcatggggagttcctgaaggctttttgtagggcagtgacaggtccagagacctaattaatattctagaaaattatctctacctgccacaggagggatggattgagggacgtgaggccagaggcctctcttccaagaaacggaagtgataaggccctgaaatgggcatgcagatagaggagaaattaagaggagaggctctccaggacacaacgattggttggatgcagtgctgacagtaagcaggcttctggcttgggagcctggttgggtgggagtaccaggtcatataaagacacgggaagaggagtcagtctggagtggacagaggcatgatgagttttgaaaacgtgaatcctggttttatcactcactagttgtgtgaccaagaataaatcacttaacttttctgtaaaattaggaaagtggtatctactttacacgcaggtcataatatagacctttttatgcaggtctaacatatagacctgcagacctgtaaactcaaaaaggctgttcaattgctagttattacatatacaataacacagtttgctgctcatgtagaagggattttaaaggtgctaaaagacatcaatctgaaatgtttcctagctataaagctcttccagcagactccttatgttatataaatgctcatttaattttcttgccaccagactgtaagcttcctaagtacagggattgggccttgttgaattttttatttttaacgtgtagcaagtgcctagaacatttcaggttcccaagaaatgttaagccagtgaaggaaggaattttatcttcatatgttcttttactgaatatagctttatggatatggaatttgtataccatacaatttaccctggtaaagtgtactctacagtggtttttaatatattcagagttgtgcattcatcattacaattttagaacattttcatcaaccccagaaagaaaccccatacccaataatagtctacatttcccttccacccgtacccctcctcggccttaggcaacactaacatatttctctctctgtagtgcttctcctggacatttcatataaatgaaatctacaatatgtggtcttttgtgatacgctttgttttttttttttttgagacggagtcttcgctctgtcgcccaggctggagtgcagtggtgcgatctctgctcactgcaagctccgccttctgggttcaagcgattctcctgcctcagcctcctgagtagctggaaatacaggcgcccgccaccacgcccggctaattttttttgtatttttagtagagacaggatttcagtttgtcagccaggatggtctcaatctcctgaccccgtgatccgcccgcctcggcctcccaaagtgctgggattacaggcgtgagccaccgcacccggcctgacaggcctttttcatattgaataatgttgtcaaggttactctatgttgtagcatgtatcagtatgatttcatccttccctcattttggctgaataaatattccatgattaccacactttatttatccattcatcagttgatgcgacagactatccttttaagaatgaaatgtttattcaaaaggaagcataaaaaacaccatcacatcagtatggactggtgtatggaacacaagacaaatatacttttatgtggaaaaggggaaacaagaaccagaatgagttattctccattcctcaccccttttacctcctctctcaccttcccctcaaagaggaaatctgggaggggatgcaaggactctccaaaagggaatggtctcactgcttagtgggcccttcccagtcccatcagcctggtgtggtttatgtaaacctcaagactagttagacacaactttctagaagcctgccctgatctctcaggcagtttttagttctatcttcatattcccagagaacactgtacttagattcatttgcatttttctcattgtattgcaatggtgagcagaggaaagagcatcagatagtcctaaatagttcgaccactgaccacctgctgaccatggaggagtcacctacttacaggctgcagggttgttgtgaaaattaaataaggtaaaataggggaaattattgtgatatagtagagtggaagggacttaaaaatcatttagtcaacttgacacttcttctgagacttttttttttttttttttttttgagacggagtctcgctctgtcgcccaggctggagtgcagtggcgcgatctcggctcactgcaagctctgcctcccgggttcacaccattctcctgtctcagcctcccgagtagctgggactacaggcgcccaccatcatgcccggctaattttttgtattttttagtagagacggggtttcaccatgttagccaggatggtcttgatctcctgacatcgtgatctactcgcctcagcctcccaaagtgctgggattacaggcgtgagccaccccgcctggccagagactacattttatacatataaaatctcaaggcatttacttgaaatttcttgacgcagacaatgtaatataaaatgagttgcaaagttcggagaacgctagagccagctaactccttgatggcattgcattgctaggtctactttcttgccctagcaaaaatggcagtttcctttctggattactccctcctcaccttctgttagtttcagagtgacttgttgataactgccaaggtccccagaaagcgcctagccaaaaaggttcttcacttctctttaaagatgtgcactccctaatacatgaaacagcattttctatttcttaatttttctctcatttccagctgctgctttcaccgtcttctggtatttttttgtttggtcgtccactgctaaactcccagctcttcagaattcaaaatgagctttgcatccaagctgttgtgggttcgaatcctgggtctatctagcgtttctttctccatctgtaaaacagggttaaaaatacctattttgtaaagttgttctcacatgtgggtattgaagagcttaatagtgtgggtggtgttttaaaggtgacgcatccttacaacaggaaagggcttaccctcttccgcagttctggcttcgaggaggtcaagccctttaaggtggcatcgccctaagtcgcaggagcgggtctctccgcccctccctcgggccggggggcggggcctcctaatccggaactgaaggtcttgcgtagccggcaccgcccatctgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcaggtcggtgtcctaacctcccaccctcctccagcccgccctgtccccttgcagagcgggctgcctcccagactagggtcagggactgcggacgggaacgcacagaaaaagccttcaccgtgctagtaggaaaaaaaaaaagtcaccatctgtcctggcctcgattcccctgatggaagtgcgtgtgactgcaagctaagccagcgtgggcgccagtgcccttatttattttcaaaacagccgtttctcccagctacagcctcctgtttaaaagacgagctaattaatttttggctctagtgctcatggctgatgtagtgagatttggctcacacagtggatggattataggacctctaagaacagtctgtttcttaaaaacgggtgttagaggttccttttctgaagggatatgtgataggtgtccacttgctttgaaccctttagtgcaaaggtctccagaaacagctttttcttctcagaaggtgtcttggtccgttttctaatcttgtagaggttggccagacagcaggcactggtgttttccattgttgttctctgtccatgatttttagacttctctaagcgtttgagacaagaatgggaggattattgtgtttgcaatacagtgagtgttcaataaatagataaagcagctgatgtttaattgaggaccatttgctgctttttttgttacccacacgctaggacagctgggagtgctttggttaagctccggggttgctaacgcaaattggttaaatctggggcctaaaaagagtcgccgattttagaagttctctgttcttgataggagctgtaattcagaaataggcaagctaatagatctaagggtgtttcactttaaggtgtgactttcaagactagttcagacctacattctggggactggattggggcagctttgaatggtgagcagcatctactagctttgctacgtttttctatttccttggaagggccagagtgtcatatctgttataagaaatataataattgccacctttgacattcttgcctctatggcagggcagaaacatattttagggggaagcggtgtggcatctttttaatttgttttcttgcccatgaaccaacagcattcgagcatttccgatgttagaatttgcctattcccctgtgcccggtactttacatacatttacatataatttttgcagtaatcccattttacagataaagtagtagaggttagctagagtgttttgaagtcccctttcctctggtatctggggaaggaggaatcacaatttatagcaggaaagatttctggcatggcttttgtaaaatgttaggtaaattaccaaaacaggtaaataaatatttcttgaaaagaaataaaagcagcagagatttttctagaagagtgaatgccaagcctccggagacgagcttctaggaggcagaacagttctatggcatccctggattaacctttgagatatgactataatgagcctgggaatattaccttctagagcataaaacactttaaagattcattcttgtcccagtctggaagatatttgggggagaggatgatttcttggtctagggagtcctttataatttgaatcacttccctccaaatggattactttctcccaaggaacctgaattgatctccctctttgtcctccaaatttctgatttttgcctcagcctagaatggacttactggctatttttgccctggactaatgctataattttaagagtgagggggctgtagtcctagctactcaggcccaggtgggaggattgctggagcccaggagtttaaatccagcctgggcgatgtagtgagacttgactctttttttttttttttttttgagacagtctcactgtcacctaggctggagtgctgtggcatgatcttggctcactgcaacctccgcctcccggattcaagcaattttcctgcctcagcctcccaagtagctgggattacagggacatgccaccacgcctggataatttttgtatttttagtagagatagggtttcaccatgttggccaggctgatctcgaactcctgacctcaagtgatccacctggcttggcctcccaaagtgctgggattacaggcgtgagccaccgtgcccagccgccttgacttaaaaaaaaaaaaaaaagagtgaggaggctgaagcctcgggaataggccagtcattcgggggttgagaacaggtttttttcctggacttactaaacatagctggcttgatgtggtagggtggatagacagctttgcaactccagtgtcgcagagatgggccttgtgtaccaataacttgtagatgtctaattcctttcctaactgtctagcactgctgactttgggcaagtcacagttaaattttgtaccctttatttctcattttagaaatagggagatatatatatatatctcaagatagcaggagaattaaagagaaagtaaaaacaatctgcctatacttttgtgtgctgaaaaagaaaatatttagttatgaaagaagttcattcatgttatataatcctgtaatgggctgggcgtgatggctcacacccgtaattctagcactttgggaggccgaggtgggtggatcacgaggtcaggagttcgagaccagcctggccaatatggtgaaaccccatctctactaaaaatacaaaaattagccagatgtggtggtgcatgcctgttgtcctagctactcaggaagctgaggcaagagaattacttgaacccaggaggcggaggttgcagtgagccgagattgcaccactgtactccaacctggcgacagagcgaggctctgcctcaaaataaaataaaatcctgtaatgtctgagggtttttgttgttgttgttgttttgttttttgagactcttgctgtcttacccatgcagtggtgtgatcatggctcactgtggtcttgacctcctgggctcaagtgatcctcccatctcagcttcctgagtagctgggactacagtgtgcaccaccacatctgactaattaaaagaaattttttttttttttttttttttttttagagatagggtctcactatgttgcccaggttggtcttgaactcctggactctggtgatcctcccactcagcctttcaaagtgctgagattacaggcatgagccaccacacccagcctgaggtggcgtttttgtttgtttgtttttgagacagagtctcactctgttgcccaggctcaagtgcagtggcacgatcttggcacaccgcaacctccgcctctcgggctcaagtgattctcctgcctcagcctcctgagtagctgggattacaggcacccgccaccatgccccgctaatttttgtgtttttagtagagacagggtttcgccatgttggccaggctggtcttgaactgctgacctcaggtgatctgcccacctcggcttcccaaagtgctaagattacatgcatgagccaccgtgcctggctccagcctgagcttttaaaaatactatagaaaacagtttctataattcatccctgccaccccaaccccaactgcaagatagctacattttataaaattattctttttaatcactacaccaaaaactgctttggtgaggcagagatgcctaatatgcatctcctaagcagtgtaactttattttcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaaggtaaaggattgcgttttgttttatctgaacttgctggagacgtttgtgtagccctactactttccctctacttatccatgtatcttgctctctcatctcctttaggtctttgcttaaatggcatcttctcagtgaagcctttcttgatttccttaattaaaactgcagcccctttgcctacctgtttttctctatagcacttaattatcattgacctattgcaaatatctttatctgtctatatttctctgctagaatgtgagctccatgatggcaggtattttctcttttgctcactgttgaattcccagcacgtgaaatataatctggtataagatagggactaagtgaatgaatgaggttggaaatggcccttccctgttatattcccatggaaagattttcattcttatttgtgatctggacagtgggtggactagttcagatccatagagaaaaatctccatcactactgatacactcgtaattaatcctggcggcagttttatatgagagtgtgtgtttgagaagagagattacccacccaattagcatatactgtggtagttaccttttgaacgaaggccacaactttattatttttgtatctctattaagtagtggagattattttatattaactggtgtttctgctgtaagagtccttcagttctctcctccctcacccccaccaaagattaggaaataatgaacataaggccctggtttacttaacttggtataatacagtgtaaaacatcttacatttacatagctatttgaattaaaatgcccctcctcatacacatatcatccctttaattcttacatcattaaatgtgtttcaatgattggggtaagataagcttcttataagccttttataaggcagctggcatacacagaggttgtacttgaaccttcttcattgatgtcaaatcctatattacactgttccacactatttagaaaacaaaaacaaatggtgctttatagatgatccatatattgtcttattcttaccagtgcttcatctgtttcataaataaggaaatacaagctttcagtttcttttttattattatttaagttttagtgtacatgtgcacaacatgcaggtttgttacatatgtatacatatgctatgttggtgtgctgcacccattaactcgtcattcacattaggtatatctcctaatcaatttcttccctacaggcctgagagttagactttggtaaacattctggctcttatgtaaaacaacacattatatcatgttactcatcttttttttttttttttttttttttttagagttttgctctgtcacccaggctggagtgcaatggcttgatcttggcttactgcaacctccacctcccaggttcaagtgattctcctgcctcagcctcctgaagtagctgtgattacagatgcctgccaccacgccaagctaaatgtttttattattattatttttagttgagatggggtttcaccatgttggccaggctggtctcgaactcctgacctcaggtgatccacccacctcggcctcccaaagtgctgggattacaggcgtgaggcaccttgcatggcctactcatcttcttagttttcatgattttgaggaataatgtgattctctaaagaagttaacaatagtagggcatggtggctcacacctgtaattccagcactttgggtggctgaggcaggaggatcacttgagtccaacagttcaagaccagcctgggcaacacaatgagactctgtctcaacagataatacaaaaaattagccaggcatggtggcacatacctgtcgtcccagctagttgggaagctgttgtagaaggatcgcttgagcccaggaggtcaagggtgcagtgagcagtagtcatgtcagtacacttcagcctaggtgacagagtgagatcctgcctcaaaagaaaaaaaaaaaaagccggccaggcgctgcggctcatgcctataatcccagcactttgggaggccgaggtgggtggatcacctgaggttaggagatcaataccagcctggccaacatggtgaaaccccatttctactaaaaatacaaaaaattaggccgggcgcagtggcttacgcctgtaaaacagcactttgggaggccaaggcgggtggatcatgaggtcaggagatcgagaccatcctggctaacacggtgaaaccctgtctctactgaaagtacaaaaaaaattagccgggtgtggtggcgggtgcctgtagtcccagctacttgggagggtgaggtaggagaatggcatgaacctgggaggcagagcttgcattgagccaagattgtgccactgcactccagcctgggtgacagagcaagactccatctcaaaaaaaaaaaattagctgggtgtggtggtgtgcacctgtaaacccagctactcaggaggctgaggcaggagaattgctagaaccaggagatggaggttgcagtgagctgagactaccacttcattccagcttgggcaacaacagtgaaactccatctcagaaaaaaaaaaaatatctgcatataactttcaacttagccaaaacttaactactaatagccttctgtttactagaggccttactgatagcataaacagttgattaacacatcttttgtgttatatgttattatatactatattattacaataaagtaaactagagaaaagaaaatgtattaagaaaattataaggaaggccaggcacagtggctcatgcctgtaatcctagtactttgggaggccgaggaggatggatcacttcaggtcaggaattcgagatcagcctggccaccatggtgacaccccatctctactaaaaatacaaaaattagttgggtgtggtggcgtgcagctgtagtcccagctacttgggaggctgaggcacaagaatcgcttgaacccgggaggcagaggttgcagtgagccaagatcatgccactgcactccagcctgggtgacagagtgagacttggtctcaaagaaaaatataaggaagagaaagtatattaactattcattaagtggaagtagatcatcagaaagatcttcatcattgtcttcacgttgagtaggccgagaaggaggaaaaggaggggttagttttgctgtcttaggggtggcagaggcagaagaaaatctacgtataagtggacccacgtggttcagacccatgttgttgttcaagggtcagctgtaattcgttttatgattaatcactagtaggggaaatatctagaagacttggtgttaagggaagctaacctcagatttgaagtcatcactgagggctggccatggtggctcacgcctgtaatcctagcactttggaaggccaaggcggttggatcacctgagcacaggagtttgagactagcctggccaacatggcaaaaccctgtctctacaaaagatacaaaacttagccgggcatggtggtgggcacctgtagttccagctactcaggaggctgaggtgggagtatcacttgagccctagaggtggaggttgcagtgagccaagattgcatcactgcactccaatctgggcaacagagcaagactctgtctcaaaataaataaatcatcactgagtgccctgaaagtgaataattaatgtgatgcagttaatgcaatgcaactggacctggttgcattgataaatgagttttaactgggactttgccaccaactattatgttgtctggctttgtttttccacctttttgagccttggttattaagaacattgagaataggtgaggaaggaggaaggctagtaaggagcagattataggaagaggttatcggggatttggttaaggaaggtagagatgagatcatggctcactccagcctccacctcctgggctcaagcgatccacccatctcagcttccagagtagctgggactacagtgtgcaccaccacacccggctaattaaaatacatttttttttttttttgtagagacagggtttcactatgttgcccatgttggtcttgagctcctggactccagtgctcctcccaccttagcctcccaaagtgctgagactacaggcatgagccaccatgcccggcccgagtttcaaaaaatactatagaaaatagtttgtataattcatcccccccaccccaacccccacttgatgagagtggcgtgaatctagaaatgacaacatgtggctgtggccagactatagcaaacaaaaagccagtgagcattgaaggtgatgctcatgtttcacttgtgaagacgaaacatcttgggccgtgattaggaaagataggcaaagggggtggaaatgataagtttaattatgataatagtatcttatcccccatgcttctacataatagctattgttctttctgtttttatagattaaaatattgaggcctagagagcttaaattaattgcctaaagtcacatggctgtaagtgatagcacattttaagattgcatcaggacatagaataagacttagtttccaattctagcaaagcccattatagaaatcactaggatatacaggaactagcgtggtgggtatgaggttgtttgggttttgaggtgcagcatttgttgcagagcctcctgctttgacgttgttctgcctgataattaaaagccctaccctctgcctgctgggctgctgcaggggccaggcatcactgtcgcctttatactctgactcttttttccccctttcctgctttcaggatgaggccattcctcaaaatagtaaaaaggccacacagtgaagcctgtaccccccaggtttgatttcagaaagcttttattcaacttaatgacagtttattctttcaaaacaatatattgaagtattacacagagttcactattgtttcataatgtcatatgatgtaatgctaatgctggtgggtgatctgcagaggcagtggctgggcgagtttggggctatttgtatgactgaggtaatgtttgcatttttaataagcaagcagattctttctttggccttaacccttttgcataaatataccagagtataatttatgctccataatccaaatatctgttcctttttttatcaaagggatttctgtttttcatagcaatgtctgaattagtaatttattttgacatgtaaagcattttataggaaatgaaagattagaaaattagaaagtagctacaaatggctgtgacagaacacaaaggcaaaatagtagatttgatgtaagttagcaagattccaagaagttaacaaaccctgtatagatttcttacttgaaattcaaccactcatattttttaatgaatcccactctattgtatgtcattctaaagaaatgaaatatttgcaagagaaaagtaatatggttggtgttttatatataaagttacaaaaataattattcactcttagtagatgaatatgtgcatatttacacacatgcatgcatgtgacattctttccaaccgatctgtcatttttgttactgaccttggatacaacgtaagagattgtattgctgcctatggaaggggctgtttttgttaataacaaggatgatcaaacatatacagtgtagatactgaagtgatactaagcagctttgttgggagtttggtgtttggttgttaagaacatgatgcatgtgaagtagattttgataattaaaaggagcctggggcttttcatagtggagcgaaatctcatggaacagcagtgaaagctttcaaatcacatggaacattgagaactggaacctgaaagtgtagctagggaagaatgaagcaatggaaaaagggcgataaggagagcatgatggagctagatttcaaatgaccagtttcttcacattcttctgtcatctggacaaataaaagtctttgcattcatcagatgtctgcctctaccagctgtcagaccttatcattgcattggaaaatggcagccaaaggaggggacaagagaatggatcttaatcagagccacagtcttctctgaatggcttaaaggtaatctctaaacccaggggtaatcctaagtatattttctcccaaataccatattggaaagattgatgacttattcctgattactttatgggtttgtatttgtaatagctcttcagttaagcttttaaacatggctattcagagaagtgtgagttgtgtgtaaaaacaaaaacaaaaataaacatagctgtttaccagcattgggttagccttactcagaagagtgggaagtaccaggtgaatggttgctttcaaccgattgagaaagtgaagctgtctcaccagaacaccctcatcttttcccttactcccataaatctctgtgtgcctgcatccattcttgtttctttccattaagtctcagatgaggtattcatgcctttctctgaaacttaatgccattctgtttcactctttccatttgctgggactttgctcctgtccttttctctttttgtctcgcaactagcttagtggacctctttcctcttgttcagatatacagctcttcccatcttaaaaacagaagacgaacactttctttcaattcagttgccctcttggctaccacgctttctctgttctcatttctgctgccaaacttactgactccatgggtgctacatgctgtccctgcttccttgatacctctgccatttgggaagttcccctggacaggctctcatatacataacttcatccatatttgctgctttggaggattactagtgttttcttttcatgcttgaagtttttttctcagtccacatcctcctcttcttttccgtatttaacataggtttctatcccacttgttaaaactcccttcctttagtttatgatacctccccacccagtggtattctgttttgtttttttttttttaatctactggttagtctctattcctctctgcacagcattttgcctagtgctcttttggaaaaacaagattctaaggcgctttaagtattctgaaatgtagccattaagatgattttaagtctctgtcatcaacttcaacttttttttcttttccttcttcttttttttgagatggggtcttgatctgtcatccaggctggagtgcagtggcacaatcatagctcactgcagccttgacctcccgggcacaaatgatcttccaacctcagcctcccaaggagctgggaccacagatgtaccacacctggctaattttttttttttttttaatttagagatggggtgtcactctgttgtccaagctggtctcaagccctgggctcaagcagacctcccatcctggcctcccagagcactgagattacaggtgtgacccactgcacctggccagcttcaactccttgttctgtttgtccatcatcttgctctgtttgtctatacagtcgctttaaattcagcgtattccatcttccacttgtgtattatgtatttattcattttatttattcaacaaacactggatcttcttaggcaagtagtgtacacttgaaaagaatgtgttctgtagttaatgggtatagtgttctataaatatcacttaggtcaagaaatggtgatgttcaaatcttgtgtgtgcatattgatttatttcattaatttgatcacttaatgaaagagaggtattcaaatatccagctatttttgttaatttgtctattctggttattccattggtttctactttgtgtgttttgaaagtctattattaggcatatatgcattaaatattattatattgatccttccgtctttatgaaaatgtgctacctatgtgttattacccctgtcttgtagtctaatttgttttctatcaatatagccactccagctttcttacacttactatttgcatagtataccttttactattctttacttatttttatcgatttatgtctttatatttaaagggcatctcttgtagacagcatatagtagggtcttgcttttgtatttaggctatcgtctgctttttaattggtgtgtaaattgatatggttggatttaggtctcccattttgctcttcattttctatttgtgctgtgtgcttttggttactttcatactcctttcctgcttccttgcattacaaaaatttttttttagtatgtattccattttagtttcttttctggctctttaagttatactcctttgcattatttttttagtggttgctctagaggttacaatatagtcttgatatttattatagttcatttagaattactattgtatcacttcatgtaaaatgtaggaaactttcaatggtgtggtttcattcaccccccacttcttttttttttttttttttttttttttttttgagaaaaagtcttgctctgtggcccaggagggagtgcactggcacaatctcagctcactacaacctctgcctctccagttcaagtgattcttgtgcctcagcctcccgagtagctgggactacaggtgtgcgtcaccatgcctgtctaatttttttatttttagtagagatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacgggatttcactgtgttagccagggtggtctcgatctcctgaccttgtgatccgcccacctcggcctcccaaagtgctgggattacaggcgtgagccactgcgcctggcctactgtgtccttttaacatattccccttatactttgaaaatgtctttattttctggcacaatataatgttccagacttattttgttcttccatgtctccagctctagaatcgggtatttcttaaaggaaccctggttcttttagtgaagggtcttatttagaatccatttctggaccttctcagaagatttagctagggaatccatagatacacacccacacatttacacctatgtttattttttatatgttcgtgtatttggcaacacgatcttgccctttcaccctggctggagtgcagtggcacaatcacggctcactgcagctttgacctcctgggctcaaggaatcctcctacctcagcctcctgagcagctgggactactctgcgtgccaccacgcccaactaatctttttgtattttttgtagagatggggtttcccaatgttgcctaggctagtctcaaactcctgggcacaagcgatccacctgcctcagcctcccaaagtgctgggattgcaggcatgagccaccatgcctggcctatattttctatatattgaaaatgacaagttcacactaatatgttctctatgttctttgatctgcaggtttgtacttttaatcgaaaactttggtcattatgtcttccaatatttttctgctccccccacctgctttttgtgggacgccaattcgatgttagaccgcttgatattttcttacacatcactgacacacctttcaatttttatttttagtcttttcctttctgtccttactttggataatttttactgctgtgtttccatgttcagtggtctttttttctgtcatgtctgtactgcttttaatctcatccaaggtgttcttaatttcagatgctggtatttttcagctttagattctcccccttaaatgtctttgatctctctgcttatcatgcttatgttttcctctactttttgaacgtatgagtacttcaattttattttaattttatttttaagagggagtttcgcccttgtcgcccaggctggagtgcaatggcacgatgtcagctcactgcaacctctgcctctagggttcaagcaattctcatgccttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgcaaactttgctctctctctaactcagtgaggctgctgggctttttttgatgtccattctgctatggactgaatgattatgtctccccccaattcacaggttgaaattgtaatccccaatatgctgtattaggagatggggccttgggaagtgatttgatcatgagggtggagccctcatgtcatgggagtcacgcccttacaagaagagaggggagagaggttccttcttccttctgttcttagccatgtgaggacacaaggagaagacagccatttgcaaaccaggaagagtgccctcaccaaatatccaatgtgctagcacctaaatcttgtacttcccagcctccagaactgtgagaaataaatgtatgttgtttaagccatccagtttatggtattcttgttgtagcagcctgtaccgaccaagacacctccctggtctgcctcttggaaactgcctttaggtaataagctgggaaaatggtagggcttgttttccttctttcagggatcaaagtcctgtgctgcctgttatacagtatcggaaatgagtgtttcatatatttttgtctggttttctagttgtttattattgcataatagcagttaatccttcatgtgcagaggcagaaatccttaaaaaaatgctttttaatccatatttttctgtccgataccagtttttccattttacttataagaccctcctgccaacagcctttaattggtcattcatttctgcaacatattgataagcacctgctaagtgcctgatgtggtcagacagtgcaggtacaaaaaatagaagacatagttgctgccctttaggaccttattgttttgtgagcgatttagacaggtaagtattcacaataatatcatattagtaacactggccacatgtcccaaagagtagataaacatggaggagataattattaatttggcctgggaatttggggcaggcttcctagaggaagtagaattcagctgagctttgagggatgaatagcaggtagctacatagagaaggcagggttgcagagagtattcttttttttttttttttttttttttgagacggagtctcgctctgtcgcccaggcttgagtgcagtggtgcaatctcggctcactgcaagctctgcctcccgggttcacgccattctcctgccttagcctcccgagtagctgggactacaggtgcccgccaccacgtctggctaattttttttttgtatttttagtagagatggggtttcactgtgttagccaggatggtctcgatctcctgacctcgtgatccgcccgcctcagcctcccaaagtgctgggattgcaggtgtgagccaccgcacccggccaagggtattcttagtttaaaagtcttctatatatattttaaaacatatttaaaagatgctggccagtcacagtggctcatgcttctaattccagcactttgggaggccgaggtgggaggattacttgagcccagaagtttgagaccagcctgaacaacatggtgagaccctgtctgtactacagaaaaaaaaaaaaaagtttatctaggtgtggtggtgtgcacctgtactcccagctacttgggaggctgaagtgggaggatcacttgaccctgggaggtcgagcggtgttcatagcgctgtactccagcctgggtggcagaatgagaccctgtctcaaataaaataaaataaaataaaagatgccaaaaagaattcttaaccaggtcgggcactgtagttcatgcctgtaatgccagcactttgggaggctgaggtgggtggatcacttgaggtcaggagtttgagaccaccctggccaacatggtgaaaccccatctccactaaagacaaaaaaattaaccgggcgtggtggcgcacagctgtaatcagctactggggaggctgaggtgggacaatcgtttgaatgcaggaggcagaggttgcagtgagctgagattgcgtcactgcatccagcctgggtgacagagtgagactgtctcaaaaaaaaaaaaaaaaattattaaccaagtttgtatttggaatatactgcttttcttttcttttctttttctttttcttttgagctggagtctctgttgcccaggctggagtgcaatggcgccatcttggctcactgcaacctctgcctcctgggttgaagcagttctcctgactcagcctcctgagtagctgatattacaggtgcctgccaccatgcccggctaatttttgtatttttttatagagacaatgttttaccatgttggccaagctggtctcaaattcctgacctcaggtgatccatccgcctcggcctcccaaagtgctgggattataggcgtgagccactgtgtccggcctgtagaggaatcttaaaactgtcatagttggcctggtgcagtggctgatgcctgtgatcatagcactttggaaagctgaggcaggaggattgcttgaggccaggagtttgagaccagcctgggcaacatagacctcatttctacaaaaaatttgaaaattagctggtcatggtggcatgtgctggtaatcccagctacttaggaggctgagatgggaagctctcttgattccaggagtttgaggctcagtgagctccagtcataccacggcactccagcatgggcaacagagtgagaccctgtctctgaaacaacagcaacaacacagtcataggtatttaataacgtttaaatattttttccatcaaaattcagtttcacagaaagccagtgaaatgcaaagtgacattttaaagaatgcacttggatagataatcatttgcttctaccaactggtgaaaatcatcagcaaaagttagtaatcatggttttttttgtttgttgttgttgttgtttttgagatggagtccagcccaggctggagtgcaatggtgcaatctcagctcgctgcaacctctgcctcctgggttcaagtgattctcctgcctcagcctcccgagtagctgggattctaggcgtccaccaccgcgcacagctaatttctgtatttttagtggagatggggtttcgccatgttggccaggctggtctcaaactcctgacctcatgatccgcccacctcggcctcccaaagtgttgggattacaggtgtgagccaccatgcctggtctgtaatcctgtctctaaacatttttagcagtatatgaaagtgtcagtaagtaaatatttatgaacaaaaagtctgttttgatttgcaggattttcggaacaggtgacaattgggattgctttgctcttcagtcttttttttttttttttgagacagagtctcactctgttgcccaggctggagtgcagtggcaccatctcagctcactgcaagctctgcctcctgggttcacgccattctcctgcctcagcctcctgagtagctgggactacaggcgcccgccaccacgcccggctaattttttgtatttttagtagagagggggtttcacagtgttagccaggatagtctctatctcctgacctcgtgatccacctgcctcggcctcccaaagtgctgggattacaggcgtgagccactgcacctggcctgctcttcaatcttttttaattgagggcttttctctaacttaaagaatcagtatctttttatttcagtaaatcttatgttatgtcaaaattaatttttctcagccataggagaaggaaaaaataaatccaacagagagttaacagttacataggccaaaggcaaattaataataaatgccataggtctttctcatattttgccatttttaaaataagatggccttcctttagtgtagtaattaaatttatagcagtcctgtgtttaacaacacttttaccactagatgtcactagactaaaacaattggtaagcttgttgaaactgctgcaacctggtgcagtcttttcaaaggcctttggttaataaggcttcctctgtagcacctgcatttctcataaaactaagtcacagcttgcttcaagcacaagctgattgggaaatatacatgttctgtgacacgttagtaatctagaattacttattttagtgtttatcaggacagaaaaggacaaatcttactaccggaggaaactttttagtgaccttaattttttggagagaaaacgattttcagtctatctctgtactcagagaagcatttatcgtcacacctcaggtttctcaagagttgagattttgtccttttttttttttttttctcgagacggagtcttgctctgttgcccaggctggagtgcagtggtgtgatcttggctcactgcaagccccgccccgccaggctcaagcaattcttctgcctcggcctcccgagtagttgggactacaggcgcgcaccaccatgcctggctaattttgtgtatttttagtagagatggttttcaccatgttggccaggctggtctcaaactcctgacctcaggtggtctgtctgcctcagcctcccaaagtcctgagattacaggcatgagctaccatgcccagccaagagttgggattttgtcttagacatcgtggatttcttagggcccagcacaaagcttggcacttggtaggtactcagtaaatgcaattaagcattagggtagtatactagatgtcatgggggaaaagatagctcacaggtcctctgctctcaagaagtctcatttgggagataatacatgcccacagcacagggtattgtatgtaaaccaaatgagtagtgcattcactagcttctgtagtatttcaggggatcagtagctcttgagagctagcggtagtgatcaaaggtgtccttaagagaaagcatatttagagatgcaaaagtaggacagttacaagtgaagaaagcaatgagccaaggtttaaggataggaaaatgcaggcagtaaagatttagaaagataaaaactcaagggccctgaatttaaagcatacatttaggtttaata

SEQ ID NO: 91 - DNA, 342842 bp, Homo sapiens
catccagtcagtcttgttttgtcacactaaaaatttcaagataagtccataacaggagcataagtaagatactgcaaggttctgaccttggcctcaaccttactcaagatcatatcacttagcttggttcctgccatacttagcaaaggaccctatacatgctagatacttattgaagatttgtggactggacttaaataaagaggtagaggcatatcaatcacattggtaggtggtaaagtgttggacagaatatctgacacaatggatgacagaatcaagggtcaaaatgacctttttttttgagacagagtctagctctgtcacctaggctggagtgcagtggcatgatctcggctcacttcaacctccaccacctgagttcaaaccattctcctgcctcagtctcccaagtcgctgggactacaggtgcacgccaccatgcccggctaatttttttgtatttttagtagagacagggtttcaccatgttggccaggctggtctcgaactcctgacctcaaatgatgcgcccgccttggcctccgaaagtgctgggattgcagacgtgagccaccacgcctggcacaaaatgatcttaacagactgaaaagatggtctgaaaccacaatgacatttaaaagcaatacagctgggtgcagtggctcatgcctgtaatctcagcactttgggaggccaaggtgggcagatcgcttgagctcaggagttcaagaccagcctggccgacatggtgaaaccccgtcactaaaaaaaaaaaaaaaaaaaacgctaaaaatttaggcaggcatgggggtttgctcctgtagtcccagctactcaggaggttgaggcatgagaatcacttgaacccaggaggcagaggttgcagtgagccaagattgcaccacagcactccagcctgggcaatggagtgagacttcatttcaaaaaaaaaaaaaaaaaaaaatagagacaaagctaaaatggtgcagctctaagtccaacgatcataattgtttaagttaaagggatttctgcacacagcaattatttgttgagtccccaatatgtaacaaatacacactactcaaataaattaatcctcccaataaccttctgaggtagaggtattagtgtcccttttagagatgaggaaaatgtgatccaaagaggttaggtgacttgaccaagatcctaaggccaatatacgacgttttcgatctctgaattatctccaaagtctgtgctttttcctatcatgccacactgcccctctgcactctcatgaattgcaggaatttattccaagttacaaagaatcattccagttctgcttaaacatttctagtaattaagatagtttaatactatgcaaggcagcaaaaaggttacagacatagacttttgagaacagtcagatccagattaagaacagctgctcagccacttcttagctgcacaacactggacaaatccttatctctaaacaacagtatccttatctataaattgagactaaaaagtacccacatgacaaggatgctgtgagaattaaatgtgagacgctgtctgaaaagtgcttagctcactgtgtgacgtattgcaattgcccaataaaaattaccattcaaattattatagaaagttctttttatcaaaccaaactctacctcccaataatttctgtccactgatctcagttctgatcactgggactttataaaattagatcaaatcctgtatctatttggcacccatgtaatattagaagagggttatattctgagtcgtctcttctgcaaaccaaaactgtaatctgcttcaaatctccttcataaaaaaaggtcggccaggtgtggtggctcatgcctataatgcaatgccagcactttaggaggctgaggtgggcggactgcttgagcccaagagttcaagaccagcctggacaatatggcaaaactccgtctctacaaaaaatacaaaaaaattagaccagcacagtggtgcatgcctgtagtcccagctacttgggaggctggggcgggaggatccttgagctcaggaggcagaggttgcagtgagccgagattgtgctgctgcactccagcctgggtgacagagtgagaccttatctccaaaaaataataataagacaaggtttctggacaatgacttctatcactcaactcaggatgtaccctagtttaaaaatctcttcttaaacatgacacccagaatactctcgcaggtgtacagtaaccattgccaggtgcctgggactactgcttccactttctgaacttgagatcaaaaaagcccccactgaattgctgttgagccagttttcccacaccctatccttatacaactggttatttttcatctaaatgcaggactttacaggtactgcttttaagtgtttttgttttttgttttttcagatagggtctcactctgtcactcaggctggaatgcagtggcatgatcttggctcactgcaacctctgcctcctgggttcaagtgattctcgtgcctcaacctcctgagtagctgggactacaggagcacaccaccatgcctgcctaaattttgtatttttagtagaggcggggtttcaccatgttggccaggctgttcttgaactcctgacttcaggtagatctgcccgccttggccttccaaagtgctgggattataggtgtgagccatcgcgcccggcctttgtctctatttttgaacattagaattacattatctctcatataatacatgctaatataccaattagaacagaagttttgattgctagacttgattttgtttacaatttggtacagatcaggtgtgtatgtttactttttatggtttttctttcattccccttgctgatagcaagtagcagctactgtcagcttggaaaccaaaataaaatcaatagccctcggccgggtgcggtggctcatgcctgtaattccagcactttgggaggctgaggtgggtggatcacttgaggtcaggagttctagactacactggccaacatggtgaaaccctgtctctactaaaaatacaaaaatgagcctggtatggtagtgcacacctgtaatcccagctactcgggaggctgaggcaggagaatcacttgaacccaggaggcagaggttgcagtgagctgagatcatgccactgcaccccagcttgggtgacagattgagactctatctcaaaaaacaaacaaacaaaagacaaaccaataggcctctgaggcagtctgaagggcttcctgttattaaaatacacaggaattaatacatgggatttaactattttggtgacctgtaggccatttttggttttccctgtttcttggctgttcagggagttggaattattaaataagtaagatataactggatgtcacataatttttgccgccctttaaaaaaaaaaaatttaaagagacagagtacgttgcctgggctgaactcaaactcctgggctcaagtgtctgccttggcctcctgagtagctgggactacagatgtattccatcttgccaggctgatttttgctcctgaggattacaatctagtatagaaaacaaacctcatggttgacttaaagtgtaggattttacaagcatagtgttcatttagtagtgtataatggtatcataccttctgtgtggagtgcctgtttcccatgtgccaagtgctacactggttgtacttcatacaggacctttgcaagtcttcaaaaacaatcctatgagggaaatattaacatcatccacatatagataatgctgagctacagagaggttagacaacttgctcatcttccaaaaagatttaaactcaggtctgtcatagtccaaaggccggatggtttttaccacaggggaagaggtggaccatagtcataggaaacaactgtatatagagaggaatgattaattgagctgaacctaaaaggacaggtggggttttggtgtgatgtgttaggttgggttgggaaggtggatgaaggagttctgggctggcaagagagtctgagcaaagtgggtctgaatatcctgcattgaggagatggggtggtggcagagtgatcactctgtgaccaaagagaaggctgcaatttgagagggagtaagaggatgagacaattattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaactagtaggagccgtttcactgatgcatactcaatgctccctagcctagcatccgcacaatgccttttctggccatggcggagagcacttcaaaaggaggccctgcggagggtggggtgggtagaggagcatggtagggaatgggaggggcaggtgtcttccaaagtttgcagttctcctaacttgttttgccctaggtccgctgaatgcagtattacagtcatggcaaatgtcaccgtactgatgtgcttaacatagatgtaatgttttctagagggtacgctaaaactcttggagggagtggggggtgggggttataaatctttatgttatttttctgttaatgtcaaggaacagttcatccttctgggtctgtatgtttaaactgagagtgaatattaataggaatttacggtactcatgttggaaattgctaccctcatttagaaaccattaacctttatgttaataaaataatgtttttaaatgagcatatgaaatctgtgttgaacagctgcggtctttccggaacactaacttaaaaaatgctcagcatactttttgaaaatcaaaagcatgtgggtgggatgaagtcacctgagcaattttctataattacaactttcaaggccttttcctttgtctttttccagctaacctaaaatacacatgcacgcatgtgcaccctcacacagacagcagcacaaacctgtgattttcttctttctctctatggactttttggccttgtttttgttaaatagttgcagttccctaggaggatatgtgttgtcttgttccttctctagtttatttgaaaccttatatctttgagaactttggaactccccagaacaggctagatgtccacctagactcccaagctttgaatgccctgtcctaaagtatttctaggtgcgttggatctaaactgattcccctagggtgacagtggaaaccccaaaatgccgacatcctagagaatgaccaggaacatgctcaagttgttacacagttttttgtacgtgctgaggttcctcagtgccatcctggtcagccagtactggaatgtgacagaactggcatttgtgcccaggaacagcctacgctgggaattcgcttctgcattctgataattaagtctgctgtgctgctaatattgttccctgaaggaaggagagctagggaataatatcattcccacttgtaccttttaattaacagaggagtggaatggaaagagttttaaagaagactttgatgagagaagatcggtacctgacatagtctggtaattccatcattgtcgaacacattttaagaataccaccgccagttttttcagtgagctaactgaaaataattctaaactttggcttattttatgtgtagaataaaattattgattttccaagagcattcattaagaagtgccttgctaagaagtgttaagcgtgaagtagtgtaatatgtctgtcctactattttaggggtcactccttcttcatcttcctcttctctttcctctaagtaaccaaagctcttcacctagaatggaatttggggcttacattttccttactatcatatagctgtttcttgttaccgaaagcagagagagctttttcagggaggttaaaattatcgttatcttgttatagtgttattttttccttcttagtaagttaggagcaatgctttgtcttcctgaagctgtctgaaaagatgcttgtatacatgtgtatagcgctttgggtcatagaaattaggtgttatgtcatctgtttcagaagatgcactaatgcatcaaaaacaagtgacagggaaaacaatgcagtgagtaatcttgttgcctcaaaactgagcaaacgttttgggagagcaagttcttgcgggacatcactaaataagaatgagttgatgtcacacttggcaagaagcaactctttaaaattttttttttccatacaaatagtacaacatgactgggaggagggattgtgggcaaagggtaaagaattatggagggaaaatgagcaggagaaggaatgtgagaatgagctgcttgctacaaaaataattaatatgtaatcaaagccatgtttgttttgtcaggaaaaatctgagtcagaacatgagctgatgaaggggagagatgtttaccatgtcctcccccacaccctcagagggccgttgtgtgcagatccctgcggagggttgtgtaaccatcttgactcattttcagggaagaatggcccctgtagctcttttggctcaatataatgctgcatcaaggatgagtgaagaagtctctggaatacagtgctatcaaactcaaaatatggtcattttaatgagaatttccaaacactaggaggcaatactgtgcagaccttgtgccaccacctgcctcccccttcccagatatctgtgcgatattgggaattcaggcagcccaatcgatagctgattttaccttttcctacaaggcagaaaatgtcaagattagccaactatttattgaaattagttggagttatctggctacatgagtgtctgtggtccagtgtatcataataagagtgggagagacggttggggtgctactggcatcttgggtgggccagcctttattgtgtgtcactgccgtgtattggcaatttttgtccctgcccactgaattgccagtggtgccccagtctctgcgatggccaggagaggccttccttcttccagattacctctgtgtgtttcaggggggctaaaacagtatgtgttttacagtattactaagcagcacagttttctttgttgttccttagcataaagatcttggaaagttttaagaagttgtgtgtttatactgtagcataggtttcattcaacctatcactcctattcactcctcagagtgaatttcagggaaaaacaacagtattgggggaaaaagtttggaaaaattggatggagggaaggaaaaaaaaaggtgaattgcaaaagggtttcttacgtagcccactattgttccccaaatcaacactcactctccagctctttgggtggttgctctgcattttcaagaggcagcctggggtggaggtcagggttgcaggtaaggtagaggggaaataagagaggacagggaagaggcaggcatgaataaaagatttggattggaatataaagatggaatacaatggagataatgaaagaccataacaaagaaacaggagattttacatggcattgttaagcttacaatgttggcattttggggacaattctgagtaccacagatctagaacttctaaaagaaaaaccctctgagataattacagcagttaaagaccttcacatacatgttgaattaatagtatttaatgtccctttgtaggtttcaatcttttaagcctgtcctgccaaagactgtgtccttctaggtgcttagccagtaatttaggtgtactgtcaccagttgtttccgtcatgacttctaagtctcagcagccattttcccttaggttttattaactgagtcagtaactcaaagtgtcattgttttccactcatctggactttctgaaaataacacagtgctttattggaaaagctaagcatagacattagccaaatgtttgctaaaaattaaccaaattaaatgttattaaataagatgtgcaaatagaggaaaattttgagaagtatgaacaaatcccactaatctttgttgtcagtcactacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaattacctcggtcaaccacatgacaaaagagtgggcatgggttttcctgaatgtctcctgaggtgaccaagggtggagtggtggtagcataataaaccccatgggaagtggagccatagattccatcagctttgcagaggggccttagacccagcagggtttaagaaactgctgtggataggatgccttgtcctccatagagattatcagctgctacctagaatttctttttcatttgcagtatgtcagcatacagaaaaaaaaaaaaaaatagcaaacacctgtgtattcatcaaatttgtcatattttaatattttgccatgtttgcttcagatctctttccctgcaggaagaaaaatacacgtttcaaataaacaacgccccctccccatcctttatatccttccctgatattccctcctcctcccactccacagggaattattgatctgattttggcattcatcatgcccatgtgttttcttcgtggcttgtctttttcctacatgtttttgtatatctaagcggtgtagaatattctttcacttgttttgactttatataagttgtgttctatatgtatccttcagctacttgtgtaactttcttttttcttttccttataattttgagatttatccatgttgatatatgtctcacttattttcactgctgcgtagtattccatcaaatgaatatttcacagtgtatccattgacttattagtgaatatttgagttgtttccagttgttttactattaaacagttttgcagtggacatctttgtacatgtctccttttgcacatgtatgagagttttctctagggtatgtaactaggaacaaattgctgtctagtagggcacatgtattttcagctttactagatacagtcaatttactcttcaaagtagttatgctcttttatcgccttactagctatatattagagttcctgttgttccacatcctcagtaaaaccggatattgtcccagctgttccttgcttattgattaatttaaagacaacatcgtgcttagcaaccatctcaaacatagggtcagatgcaaacttaattttcttataccatgcttcttccttttaaaagaattgttttgatttctgagttacaaatccaagataactataacatagcttttttgccatatttatttttttaataattttttttctgatcacgaaatgaatatatgattattttaaggaacttggaaaacaaaatgacaaaaaagaaaattaaaaattctacctagacatagccattgttaataacttgctatatttttccttctagtgtagacctatgtaaagtatacatttactttataattaaaatttgtcattttatatcacaattttacttaaaattctattgtggcatttcccatgtcattggatattgtttgaaaacatcatctaaggccaggagcggtggttcacgcctgtaatcccagcactttgggaggccaaggcgggcggatcacgaggtcagaagatcgagaccatcctggttaacatggtgaaaccctgtctctactaaaaaaaaaaaatacaaaaaaattagctgggcttggtggtgggcgcctgtagtcccagctactcaggaggctgaggcaggagaatggcgtgaacccgggaggcggagcttgcagtgagccaagatggcgccactgcacttcagcctgggctacagagcgagactccgtctcaaaaaaaaaaaaaaaaaaagtgtaaacagctggataacatttctttttgtaaatataaatatagtttaatcattctcccattggaggacattttgggtattaaaatgatactggagtacaaaatcttggtgcataaatttcatctgagtttgtttctttgggatagatttctagaagccagtaactattcatggaattagattggatagctgataaaagcagggcatcaagggagaaaaaagagttgagagagcaaaacaacatgcttaaggatcatgagattcgtgaattcagcttctgtcatatttgaattgagtggcaaatttgtctcttacctgaatttggagacccttctctaattagggatgattattagagggaaattctgccctactgtggacaccagagagttggttgtgtgttgtagtgttcaagagttttatccaatattctgcttcctgcagagttcctgaattgagggtcttttgtggaatatctcattgaagtagacttttaaccttgacttgctcaacatctgatcagaagcagctcgttgtcatataaggaaatctgctctgttatggaacatctttgagtagttgagttcccctttttcccataagtccaaatttgattccctgtcaccttcaattgttctttaacttgtttttaaacaaaagtctccctaaaaataattccagaagtatttgaactttatttctctattagcttctactgtaattaacatgaaaacaaacatgttttaaagtctttgtttccttctaaggtataatttagctttatcacgtcttcatagtgaaagttgtatacgtgaacgttggtaggatagaaaaactttccacatagttttatacttggtgcccagaaaacttccaaagtgtttaggtactactcattattatttcttagaaattgaatagaagcagtggcttgagtatacacagtcccactttttcgttaataataaccacatttccctttttttttttgcacaaaagtgttacatgtattttctcgtttaatccttgtacaacctattagggtaggtattttcctcatttggcagatgagggtgctgaggctcagagagatgaaagacctttcctgtcacacagctattaagggcagagctaggatttaaactcagatctaattctaaaacctgtatatttaactagtttgcacatctgtctccctgacttaattgcatcataaaatcaaagatatttctcttcaaaatatgttcatgttggattatttggctgtttcactgttagaggtctgttgcttctgctggcttttctgtggcaatcccagctgctcttccccgtggcttgggcacaccaaggatttcctttctgtgattgccccatatctccctagtccgctgtggggggcaccttcctgcttctgaggaaactgaagcaggagatgaggaaagggtaacaattaattacatacttttttttcccgagtattatcaactaacatgttccataaaggagcatgttttcacagctgtgtgctttagaaacagggagaaaggtttgagtttttatgactgaggtatcttcaacaaaggctgtgatgtacacgcttgatggacttggaacgtggaaacccattccctccctcagccctgggattggaatctttgtgtttatggtcacatgagtattcagatatgttatctctgaatgtgatgccctggtcagagaaccaaggagtggacttgctagattatatgatttaattaccctagatcaatcaagctttgacttactgatggcaggatatattgtgtattttttcctagttgctagaggaaaggaacaaagtttaatccttggctttgttgacctttggtatcacttttatcttgtagttccgtataactgcctttgtagactcttcaaaaggctgaaggcaagtgatttatagataagggctcattcagtacttgcacaagaagagcccatatcttcaaatatgggtgacgtaaatttacttcagaaacagaaatgagctcatttatttggagagatgtgaacagaatgtgcgtcttttgctccgggtgagaaataaatttaaattcagaactttgcttgggggaaatgaaatggaggaactaggcacttgagcctcttggaaattagagatctttagccaaggcccaagggagcactgtcttggtccatttataacaaaatactggagactgggtaatttataaagaacagaaatttatttctcactgttctggaggctgggaagttcaagattaaggtttgttgagtgctgcgtcttctagagtggatgaacactctgccctcaactggcagaaggagaatgggcaaaaaacaggagtaactcccctgctgagcccttttgtaagggcagctaatcccatttacccagagaggagccctcatggcctaaccacctcttaaaagccccacctcctattactgtcattggcaacacctgcattttggaagggacccattcaaaccatagcaagcaccaatagtatgtttcagaactcatccacataggagcactcctcagcatgtccaacagcagtctgtggagaactacttttttgttttggtttggttttttgttttcttttttgtgacacagtctctgttgcccaggctggaatgcagtggcatcatctcagcccactgaaatctctgcctcctgggttcaagtgattctcctgcctcagcctcccaagtagctgggattacaggtgcccgccaccacacctggctaatttttttgtatttttattacagatgggctttcaccatgttggccaggctggtctcaaactcctggcctcaagtgatccacccacctcggcctcctaaagtgctggcattacaggcatgagccaccgcgcccggccagagaactactttgtgtaagtctacgaggcaccatacacactttttcccttaaggaccttactgagtaactgggaagagagagcaggaatgtcaacaataatacagaagaagggttctatggtaaatgccgaaagtgaaccttcaacgaagtgagttccagagagacaacccataaaggtaaagatttagtcataaatgagctgtgttgctactgaaaacatcttgattctaaagtataaccacatctcaaccaagcaaaaactgtcttaagcctgaattaagaggaaaatgatattttaaatgaactcctcaagtaagttgccaaatcattgacactagaattttaagaattggtgactctagagctttcatggtttggctactgtattatctccctcaaggtgcagtaatatttctgtcaccaaaaatcattaattgataacattattctttctgttagttctagcacttatttccatcactgtgatttttttattatgatgattatttttactttacttacttagtataggggattacctgccttttaatgtcatcctgacaattaagacaaaatacagaacatgcttagcacagtgcttggctgagagagtgccatcattaatattaggcattatttttcttattcttgaaatacagtgttttatatagtgcctggcatgtagttaaattttagtaaattataataatgttgtttattgttttccaaaggatttttaacatgtattatcaattaatactctgagctacattcaaggtatatagtgctattcctcttttactaatacagaaactgaagttaagtacattggtcagatttttctggctgatttaagcagataaagaaattattaaaaggaatgtggatagctcacagaatcagcagaagagctctagaatcgtgttttgggctacctagccaagtaaaatggccaagatcatgccacagaactgagccactgccaagtacctgccgtgccttgcacggcaaacaatgctggctggcattggtgaccggactttgccacagggattgcttctactgctcccttggaaactgttttacagaaactgctgtcaccaaggaatgtacttcatggaaggccctattttgcaacatttgccccctatttacagtctggagtgggtggcaatttgctttattgccaactcattgtgtcttaactctctgtgaaagaaatacttcgtttatattttcttttaattggatataaactgagtagaagttgagattattttccttattagtagacttcgtgtgtggaaaagttagttttttctgaaattgatcttgttcttagcaattatctgctataagtattgcctcaactttttaggctactactaaatgagaactttccatctgatcagggcgtcttctccagtgtaaacaatcctgtttcccattacccattggagctaaggaacccatgatgagttaacacgtgcaagaagggttacccctttgagcaagaaaagtcctggcattagtatttcagatttttttcttgcatccttttctgatattttatttattttcatttaaagtggacctatggtttatcttgctgaaaatctcaaaaaaccaaaaaacaaacaaacaaaaaaaaaacgtgtcaggtccctaatgtgattgctgttaaccatataaaaataacctcccctcttttataatcagtcttggtgcgccttgcaaagcctacatttctaacctgtgtatacttcaaactactgtgagcatgtgttaaacacctttttttttttaaataaaaagaacactttcagctccttaaagcaagctcttttgggaaggaaagaatccctgagtgctgcagccatccatcctgctttgtctggaaagctaaggtttttgggttattgatgtttcaacaagtggagagcacctaggtctggtgagcaccagctgctgaagtgtggggggcacccaagtggcctgttcttccaggatggcattcattcttccaggcaagtgggacaaagtgggctttctgccttcactcagtgagagctgttgaaagattttctcatctgaattgtgaatgtttgtaatgtttattttcacagtaagagtgagggccttctcactttgaatatattcctttttgcaaataattttgaagtagtcctgatcctgtgttaaaagaaacatggtatgtcattatagaagaatccttcatcccccttcccttacaaacataaaattttcagagtttacatttggaagaaaacctggttcaattctctccattttcagggaaggaaatggaatttattctttcctttgtttatccttttatagttttcattttgttccctgttggtcacatttttttttttggccttcttattagaggggtattgtggaatatttttgcttagcaaaaattaaaatcaacatacctgactttgtaattgtaaaatatgtataacatacaatttatcattttaatcctttttgagtgtacaattcagtggcattaagtatattcacattgttgtgcagtatcatgaccttccatctccggaacttctccgttatcccaaattgaagtctattaaatagtaatttcccaatctctaccctcagccctgacaaacattattattctacttattttcgccatgaattttactattctttttgtttttttttttttttgagacagggcctcacgctgtcacccaggctagagtgcagtggcacgatcttggctcactgcgacctccctctaccttacaggctcaagtgatcctcccgcctcagcctcctgagtagctgggacctcaggtgcacaccaccacgcctggctaatttttgtatattttgtagagacggggtttcaccatgttgcccaggctggtctcaaactcctaggctcaagggatccttccacctcggcctcccaaatgctggggttacaggtgtgagccaccgcgcctggccaaatattactattctgtatgtttcttgtaaattgaatcatacagtttttgtccttttgtgtctggcatacttcagtttaccacaattttttcaggttccatctgtattctagcatgtaccagaatttcattctcttttttaaggctgaattctattatgtgtatataccacattttgtttatcctttcatccattgatggacatttgggttgtttctactttggccattgtgaataatgctgctgtgaacattgatacataaatatctgtatgagtccctgctttcagttcttttgggtgcatacccagaggtggaattgctgggtcatgtggtaattctatgtttattttttttcctcccttgtaattacccacaatgtggtaaaatacacttgacatgaaatttaccactgtaactatttttaagtataagttcagtggtattaagtacattgagattgttgtgtgaccatcaccactgtccatttcctgaatgtttttcatcttgcaaacctgaaactctatatccgttaaacagcaacttcctatcctctcttcctcccagccctggtaaccactgttctactttctttctctatgattttgacttttctgtgtacttcatataaatggaatcattcagtgtttgcttgtgactggcttacttcacttagtgtaatgtcctcaagattcacccatgttgttgcataggtcagaattttcttttaaaggctgaataccacatgtgtatatatatagaaaaatattattcagtcttaaaagggaattcctttttaaggaatgcctcattttgcttatccattcttctattgatggaaatttgaattgtttccatgttttggctattgtaaatcatgttctttgaaaatgagtgtacaaatgtctctttgagaccctgcttttgattcttttgggtatatactcagaagtggaattgctggatcatatagtaattttacatttaattttttgaggaaccaccacacccctttcgccagcggctatgctataccatgttacgtctccaccaatagtgagtaagggttctacatctttgccatcatttttttttgtttgtttttgatactagccatcttaatgggtgtgagggggcatctcattttagttttgaattgcccttccctaatgattagggatgtcaggaattctttttatctatttatttattttttattttattattattatactttaagttttagggtacatgtgcacaacgtgcaggtttgttacatatgtatacatgtgccatgttggtgtgctgtacccattaactcgtcatttagcattaggtatatctccaaatgctatccctccctcctccccccaccccacaacagtccccggtgtgtgatgtttcccttcctgtgtccatgaacacatggacacttattgttcaattcccacctgtgagtgagaacatatggtgtttggttttttgtccttgcaatagtttgctgagaatgatggtttccagcttcatccatgtccctacaaaggacatgaactcatcattttttatggctgcatagtattccatggtatatatgtgccacattttcttaatccagtctatcattgttggacatttgggttggttccaagtctttgctattgtgaatagtgctgcaataaacatacgtgttcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaccctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttttgagaagtgtctgttcatatccttcacccactttttgatggggttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacattgaagtctttaatccatcttgaattagtttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagtatgatgcctccagctttgttcttttggcttaggattgacttggcaacacgggctcttttttggttccatatgaactttcaagtagttttttccaattctgtgaagaaagtcattggtagcttgatggggatggcattgaatctataaattaccttgggcagtatggccattttcatgatactgattcttcctacccatgagcatggaatgttcttccatttgtttgtgtgttcttttattttattgagcagtggtttgtacttctccttgaagaggtccttcacatccctttaagttggatccctaggtattttattctctttgaaggaattgtgaatgggagttcattcatgatttagctctgtttgtctgttattggtgtataggaatgcttatgatttttgcacatggattttgtaccctgagactttgctgaagttgcttatcagcttaaggaggttttgggctgagaccatggggttttctagatatacaatcatgtcatctgcaaacagggacaatttgacttcctcttttcctaactgaatgcccttgatttccttctcctgcctgattgccctggccggaacttccaacactatgttgaataggagtggtgagagagggcatccctgtcttgtgcccgttttcaaagggaatgcttccagtttttgtccattccgtatcacattggttctttcatgtgcttattggccatttgtatctcttatttggagaaatgtcggttcaagtcctttgcccatttatgaattgggttgtttgaggttttttgttgggttttaggaattctctatatattctggatataatatacatgtatataataaatgtatataataaaatatacatgatttgaaagtattttctgcattttgtgggctgcctttttactctgttgatagtatcttttcatgcataaagttttaaaattttcattgtccaatctatctttttttgttgttgccagtgcctttggtgtcatacttaaaacattgttgcccaattcagtgtcatgaaacttttgcctgcgttttctcactataggaaactatagtaaaaaacattaaacgttttattgttttagatcttacatttaggtcatggattcattgttaattaacttttgtatatggtagtaggtaagggtccaacctcattcttttgcatgtggatagccagctttcctagcagcatttgttgaaaaaactgtcctttcccaactgaatggtcttggtgcccccaacaatcatatgactttatatgtgagggtttgttctgggccctctgctcatttctgtggtccatttgtctgtctttatgtcaatgctgcactgttttgattactgtaattttaagttttgaaatcaggaagagtgagtcctccagctttgttcttcttttcaggattgttttggctattcaggatctcttgagattccatatgaatttttggatggatctttctatttctgaaaaaaagtcactgggattttgatagggattgcattgaacctgtaaatcacttttggtaatattgacatcttaatattaaatcttccaatcaatgactatggggtgtcttaacatttgtatgtgtcctctttaattcctttcagctgtattttatggttttttttattgtacaagtctttcatctccttggttaagtttattcctaagtgttttattctttttgatgctattggaaatggaattgttttcttaatttcctttttggattgttcattagtgaatagaaatgcaactgatttttgcatgttgactttgtatcctgccactttggtgaatttatttatttattagttctgatagtatttttgtggaacattcaggttttctatatatgagatcatatcatccgtgaacagacataatttaacttctttctttctaatttcgatgccttttatttcttctcttgtcttattgctcttgacagaacttccattattatgttgaatagaagtggtgaaaacaggcatccttgctttattcctgatcttagagggaaagctttcaggtcatcaccattgaatatgaagtttgcttgcatttcttttatatggcttttattatgttgaggtagtctccttccattccttgtttgttgagtgttttatttgtttgtttttatcaagaaagggtgttgaattttctcaaatgctttctctgcatcagttgaaatgattttgtggttttctttttttttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattggggattggtgatgactctttttttttttttttttttattgatcattcttgggtgtttctcgcagagggggatttggcagggtcataggacaatagtggagggaaggtctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacctccatccacacagacccggcaaccatctgatttctcagttttttccccacccttcctgcctttctattccacaaaaccgccattgtcatcatggcccatccccaatgagccgctgggcacacctcccagacgggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctcctcacttcccagtaggggcggccgggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggccgggcagaggggtcctcacttcccagtaggggcggccgggcagaggcccccctcacctcctggacggggcggctggccaggcggggggctgatccccccacatccctcccggacggggcggctggccgggcggggggctgaccccccccacctccctcctggacggggcggctggccgggcggggggctgacccccccacctccctcccggatggggcggctggccaggcggggggctgacccccccacctccctcccggacggggcggctggccgggcagaggggctcctcacttcccagtaggggcggccaggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggctgggcagaggggctcctcacttcccagtaggggcggccgggcagaggagcccctcacctcccagactgggcggctggccgggcggggggctgacccccccacctccctcctggacggggcgactggctgggcagaggggctcctcacttcccagtaggggcggccgggcagaggagcccctcacctcccggacggggcggctggccgggcggggggctgaccccccccacctccctcccggatggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgtggccagcagaggcgctcctcacatcccagacagggcggcggggcagaggtgctccccacatctcagacgatgggcggccgggcagagacgctcctcacttcctagatgggatgggggtggggaagaggcgctcctcgcttcctagatgggatggcggccgggcggagacgctcctcactttccagactgggcagccaggcagagaggctcctcatatcccagacgatggggggccaggcagagacgctcctcacttcccagacggggtggcggctgggcagaggctgcaatctcggcactttgggggtccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcggcgtgcgcctgcaatcgcaggcactcggcaggctgaggcaggagaatcaggcagggaggttgcagtgagccgagatggcagcagtactgtccagctttggctcggcatcagagggagaccgtggaaggagaccgtggagagagggggagggggagggggaggggcgattttgtggttttcttccctttagtcttctaatataggctgttacgtggattgattttcgtgtgttgaatcatccttgtgttccaggaataaatctcacttggtcatggtgtataatccttttatatgctcctgaatttggtttactaggattttgtttgggatttttgcatcaatgtttgtaaggtaaattggtctacagttttcttttcttgtagtgtttttgtcttgctttggaatcagggtaatgctgccctcatagatgagttagggagtgttttctctgcttcaattttttgggaaagtctaaaaagggtttatgttagttcttttaaatggttggtggaactcacctgtgaaactatcagttccagggcttttctttatcaggagatttttttattatgtattcaatctccttactaattataggtctattcagagtttctatgtggcttagccttggtaggttctagttctgtgtttctaggaatttgtccatttcacctaggttatctaatttattgctgtacaattactcatagtaccttgtaaagtcatttttattcccatagaatcggtattaatgtacacactttctcgttttagtatttgagttgtctctcttttttcttagttcctctactctagcaaaaggtttgtcaattttgtttatctttttaaagaatcaacttttggtgctggtgattttctctatttttttttctattctctattttatttatctttggtctaatctttcttatttctatccttctgctaactttgggtttagtttgtttttctagttccttaagttgtaaagttagattgctggtgtgagatctttctttttattttttattttattttattttttagagatgggtatcactctgttgccaaggctagagtgcagtggtgcaatcatagctcattgtagcctcgaactcctggactcaagtgattcttctacctcagcctcccagtaactgagactacagacacacaccattatgcctggctaatttttaatttttatttatttacttatttttttaaagagacagagtctcactaggttgcccaagctcttctcgaactcctgggctcaagcgatccttccacctccgcctactgagtagatgggattatagatttgagtcaccgcacccaactcttgttttttaatgtaaacttttttttttttttttttttgagatggagtcttgctttgttgcccaggctggagtgcagtggcacagtctcagctcactgcagcctctgcctctcgggttcaagcaattctcctgcctcagcctccagagcagctgggattacaggcaggcgccaccatgcctggctactttttgtattttttttttttttagtagaggtggtgtttcaccatgttggccaggctggtcttgaacacttgacctcaagtgatccacccgccttggcctcccaaagtgctgggattacaggtgtgagtcatcctgcccagcctaatgtaaacattgataaatttcccccttagcattgctttcactgcatttcataagttttggtatattgtgtttttgttttaattcacctttaggtttttttcagtgtcctttgtgttttcttcattgatctgttggttgttttagtatgttctttaccgtccacaaattgtggattttccagtttttcttctgttgtagatttctaacttcattctattgtggtggaagaagattctttgtataatatctatcttttgaaatcttttgagacttaatctgtgacctaacatatggcctatcctgaaaaatgtcccatgtacacttgagaagaatgtgtattctgttgttaggtacattattctgtctgtctgtgaagttgagtcagtttgttgtgtgttcaagtcctctactttattacttatcttctgtttggtggttctagtcattattgtgagtgggatattgagacttccagctattattgaagtatttttcccttcaattttgtcagtgtttgcttgacaaattttgatggtctctcattaggtgtataaatgtttataatttttaaatctttttttgagacagggtctaactctgtcacccaggctgcagtgcagtagcgagatcttggctcactgcaacctctgcctcctcattgatcctccatctcagcctcctgagtaggtaggactagtaccatcatacccagttaatttttatatttttagtagagatggggtttcaccatgttggctgggctggtctcgaactcctgagctcaagcagtccacctgccttagcctctcacagtgctgggagtacaggcatgagccaccacacttgatttgaatatttataattctttttttttatcttcttgctatatcaaaccatttatttatttatttatttatttatttatttatttatttatttatttatttttgagacggagcctcactctgtcgcccaggctggagtgcagtgacgcaatctcagctcactgcaaggtctgcctcccaggttcacaccattttcctgcctcagcttcctgagtagctgggactataggtgcctgccgccatgcctggctaattttttttttgtttttttttttgtttttttagtggagatggggtttcactgtgttgccaggatggtctcaatctcctgacctcgtgatctgcccaccttggcctcccaaagtgctgagattacaggcgtgagccaccacacccggcctgaaccttttattaatatatgatgtcctttgtctcttgtaaccgctttcagtttaaggtctattttggtcagctacagtaactcactcctataatcccagcactttgagaggctgagacaggaggatcacttgaggcagaagtttgagactagcctgggcaacatagttagacccccatctctacaaaaaaatttaaaaattagccaggtgtgatagcgcatgtctgtagtcccagctacttgggagtctaaggcaggaggattgtttgagcccaggaattcgaagatacagtgagctatcatcatgccattgcactacagcctgggtaacagcgtgagactctctttcagtatagctcttttggttactatttggatgaatatctttttcatccattttcagcctgtttgtgtatttagatgtaaattgagtctctagtagacaagcatatagttggatcaggtttttaatccattctgtcaatccctgtcttttgattggagagtttaatccatatacatttaaagtacttaactgatacagtggcacttacttctgtcattttgctattagttttctagatgccttatagcttttttttgtttgtcattttctgtattgctgtcgtcttctgtgttgattttttgcagtgaaacatttatattcctttctcattcccttttgtgtatgttatatagctgttttctttttttaaaattattatactttaagttctagggtacatgtgcacaaagtgtaggtttgataaataggtatatatgtgccatgttggtttgctgcacccaccaactcgtcatttacattagatatttctcctaatgctatccctccgccagctcctcactccctgacaggccccggtgtatgatgttccccgccctgtgtccaagtgatctcattgttcagttcctacctatgagtgagaacatgcagtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctgttgtgaatagtgccataataaacatatgtgtgcatgtgtctttatagcagcatgatttataatcctttgggtatatacccagtaatgggatggctgggtcaaatgttatttctagttctagatccttgaggaattgccacattgtcttccacaatggttggactaaattacactcccaccaacggtgtaaaagtgttcctgtttctccgcatcctctccagcacatgttgtttcatgactttttaatgattgccattctaattggcatgagatggtatctcattgtggttttgattcgcatttctctgatgaccagtgatgatgagcattttttcatgtgttttttggcagcttagatgtcttcttttgaggagtgtctgttcatatcttttgcccacttgttgatggggttgtttgtttttttcttgtaaatttgtttgaattctttgtagattttggacattagctctttgtctgatggatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccattttgaattaatttttgtataaggtgtaaggaagggatccagtttcagctttctacatatggctagccagttttcccagcactatttattaaatagggaatcctttccccatttcttgtttttatcaggtttgtcaaaaatcagatggttgtagatgtgtggtgttatttctgagggctctgttctgttccattggtctatatctctgttttggtaccagtaccatgctgttttggttactgtagccttgtagtatagttgaagtcaggtagtatgatgcctccagctttgttctttttgcttaggattgtcttggcaatgcgggctcttttttggttccatatgaactttcaagtagttttttccaattctgtgaagaaagtcattggtagcttaatggggatggcattgaatctataaattactttgggcagtatggccattttcatgatattgattctttgtatccgtgagcatggaatattcttccatttgtttgtgtcctcttttatctcgttatttcatcgagcagtggtttatagctctccttgaagaggtacttcacatcccttgtaagttggatccctaggtattttattctctttgaagcaattgtgaatgggagttcactcataatttggctgtttgtctgttattggtgtataggaatgattgtgatttttgcacactgattttgtatcctgagactttgctgaagttgcttatcagcttaaggagatttggggctgagatgatggagttttctaaatatacaatcatgtcatctgcaaacagggacaatttgacttcctcatttcctaattgaatatcctttatttctttttcttgcctgattgccctggccagaacttccaacactgtgttgaataggagtggtgagagggagcattcttgtcttgtgccgattttcaaagggaatgcttccagtttttgcccattcggtatgatactggctgtgggtttgtcattaatagctcttattattttgagatacgttccatcaatacccagtttattgagagtttttagcatgaagcgctgttgaattttgttgaaggccttttctgcatctattgagataatcatgtgttttttgtggtcggttctgtttatgtgatggattacgtttattgatttgtgtatgttgaaccagccttgcatcccagggatgaagccgacttgatcgtggtaggtaagctttttgatgtgctcctggattcggtttgccagtattttattgaggattttcgcatcgatgttcatcagggatattggtctaaaattctcttctttttgttatgtctctgccaggctttggtatcaggatgctgctggcctcataaaatgagttagggaggattccctctttttctattgattggaatagtttcagaaggaatggtaccagctcctctttgtacctctggtagaatttggctgtgaatccttctggttctggactttttttggttggtaggctattaattattgcctcaatttcagagcctattattggtgtattaagagattcatcttcttcctggtttagtcttgggagggggtatgtgtccaggaatttatccatttcttctagattttctagtttatttgtgtagaagtgtttatagtgttctctgatgatagtttgtatttctgtgggatcggtgatgatattccctttatcatttgttattgtgtctatttgattcttctctcttttcttctttgttagtcttgctagtggtttatcaattttgttgatcttttcaaaaaaccagctcctggactcattgattttttttaagggtttttatgtctctgtctctttcagttctgctctgatcttagttatttcttgccttctgctagcttttgaatttgtttgttcttgcttcttttaattgtgatattagggtgtcgattttagatctttcctgctttctcttgtgggcatttagtgcttatgctgttttctttgcacttatcatgaggattatatttaagatcctaacgtggtaacacaataatttgaatttataccagcttagctttcttttcttttatttttttttttaagtgaaaacaagtttattaagaaagtgaaggaggccggatgcggtggctcacgcatgtaactccagcactttggaaggcccaggcaggcagatcacctgaggtcaggcgttcaagaccagcctgaccaacatggtgaaaccccatctctactaaaaattcaaaaattagccaggcgtggtggcacatgcctgtagtctcagctacttggaagaatcgtttgaacccaggaggcagaggttgcagtgagccgagatcgtggcactgcactccagcctgggtaacagagtgagtcttcatctcaaaagaaaaaaaaaaagtaaaagaataaggaatgacctccagaggcagagcagtgacagcttaactttcataacatagaaaaactctgctcctttccagcttagtttccatccctttcagttgttaatgtcacaagataatatctttatacagggtgtgtccaaaatataaactaatacttttttaatgcagtaatctctcaaattatgtaaaaaaacaaaatatggagttataaactaaagttacaataacattagcttttagactaattttttttaatgtatcagtctcttaacgcagaaagccaaaagtggagctacaaaccatggttacaaaagagttacgaaccatggttacaaaaacccctgtaaatacatgggcttttttttttttattttttatttatttttttattttttgagatggagtctcactctgtcacctaggctggagtgcagtggcgtgatctcgactcactgcaagctccgcctcccggcttcacgccattctcctgcctcagcctcccaagtagctgggactaaaggcgcccgccaccacgcctggctaatttttttgtatttttagtagagacggggtcccaccgtgttagccaggatggtctcaatctcctgacctcgtgatccaccctccttggcatcccaaagtgctgggattacaggcatgaacagtacatgggcttttataatttgccatatatttacctttactgagatctttatttcttcactcaactctctagtgtgctttcatttcaacctgcaggaccccctttagcatttcttgcagggcaggtctagtattaagaaactccctcagcttttttttttttttttttttttttttttcctgactgatacgcttaatttctccctcatttttgaaggatagttttactggatataaaattcttggttgacaggttttttgttttttgtttttttttcttttagcagtttaccaccttatggccccctaggtttctgatgagaaatctgttgataatcttattaaggttcccttttatgtgataaggtgtttttcttttgctgctttcaaatttctcgttgtctttttgtttgttttttgagacagagtctcagtctgtcacccaggctagagtgcagtagtgcaatctcagctcactgcaacctctgcatcccaggctcagatgatcctcctgccttagcctcccaagtagctgggactacaggcatctgccaccacgcctggctaatttttatatttttttgtagagatggggttttgccatgttgcccaggctggtgtcaaactcctgacctcaagtgatctgcccaccttggcctcccaaagtgctgggattacaggcgtgagccagtgtgcctggccctttctaaaggttgattataatgtgtcctggtgtgggtctctgaatcctgttttgagtttgttgagcttcttggatgtttgtattcatctctttcatcaaatttgggatgtttttggccattgtttcttcagatgttttctctccctttctctttctgttttccttttgggactcccacaatgcatacggttatccacttgatggtgtctcatcaatcccttagatcagttcacttttccttaatcttttttctttctgttcctcagactagatagtattcattgtactcattattcactcattctttcttctgcctgctcaaatctgcctttgaatccctgcattgaatttttcgtatcagttatttcagttccagaacttatttttcatttctttttaggttttctgtctctttattgatattttccatttgtttatacattgttttcttggctttctccatgtctcctttagctctttgagcatctttaagacagttgttttaaagtctttgtctagtggatttgccattgtcttttttcagggacagtatctgttggtttatatttttcctttgaatgagccatacttttctgtttctttgtatgactggtgatttttttttttttgaaaattggacatttaaatccagtaatatggtaactgtggaaacagattctcccccttctctgggtttactgttttttgggtttatttttggtattttgattgttacaggatgtgtctgtgccaagaatcagccagaggtatacatgttaggtctcctcagatcttttctgagcctgtgctcttccctgggcatgcatagcaactttctaatttcccctatatatgtggttgcttttgaatatcctggtctttaatgtccgggtcccagagagggaaaaagaaaaaagtgaaggagggtgaaaaaaatgctgccccctttaatcctctgaaagtcacttcagcgtgagtgggaagaccttgcagcagtgtggtggaggtgcaacaacagtgattaccgtctgtgtctctgtctgcacctttgtgatcagaagcagccaacattgatcagagcatagattcatatttagaggacagggtccttttctcccctgctgtctcccacaaactgtgtgcaagccactccaggaataagtgcgtagctgcctgcagtggggatgggagctttgagatggctggtgctattatgatgacagctgaaatagactgaaagtaattataattcatcatccaggccttcctctggatgttgcaagccttcaatagactctagagctacaaaatagttacatcagacagagtgcaccagtgcaattatttagttgggaagataaattcctggtgcttcctaccacagtcttccccaaattccctttttagttactttttttaggaacccccatactgttttccccagcaggtgcaccattttacattgtcaccagcaatgcacaagggttccaaggatatggagaacatccttgccaacacttgttattttccattgtttggataatagccatcctaatgattaagtggtatctcattgtgttttgtatttccctcatgattagtgatgtcgagcatccttcatatgcttattggctgtttgtatatctcctttggagaaatgcctatttaaatcctttgcccaattgtgtggtttgttgttttatctttttaaatttagctccttttcatatttgccttccttataaataactcctgcttcttctggtaatctgcttgaggaatgagatcatttctttgctatttcctacagtgctagtacatagtagtgtgtgcctggtaaacacttatagtggtaggataggccagtcatacagccagcttttgaaagcctgcttaattgactactacagttggtgactggggactttgagacagtgaggaaattaacacgaattgtgtgcctcctctttgctaggtgctgtggtaggcataactttatatagttcccataatactcctttaatatgtcacacttacagatgaaggatttgaattaagggaagttaaatttagactccctcaacatcacacaggttttaaatggcaatccttggattccaattccgggtctacctgactccaaactttttcattataccatgtggtctcccttccctagtctggtaagttcaaacagagagcaagcctgcgaacctggaaattgtttagggcagatgagcagttgaacatttacttaataggagacagagaatcgtgctatattgccgaggctggctttgaacttctaggcttaagcagtcctctcacctctgcataccaagtagttggtaactacagcctattccattttacttaattattcaagaggaaaaggtagagattgtgaaatgctaattttatagcagtgaacaggattcctcgaagacactgaggtgtgtcgtttgtggatactgatgacctttggaaatactgtgtctacttttgggtgtgacatcctctgttcttgtttctttggtaccataaattagggccactggccatggccaaatgggtgcctaacacagaaggatgaagtgcttttcattgcttaccacaaattcccttgaaccctttacttctctgagacttaagaaatgcaagaataaagggaacagagttttatcaaaatcctattgtgtgctaggcaaaccctagaagggacatgattattatcttgcttttacatatgagaaaattgaggctcaaagatgtaagataaattgtccagattcacacagctaataaataagggagctgaattcagctttttccatgctgcctccattaaaaagttcctctgtcttgccctctggtgggtttcggaggtcctgggagaaatgtttgtatcctcaccaaacattgtggtgggtggcatcttacatggggcttgttctgcacttgcagtttcttctgccacatggtttaaccagagcaatgatgactgccgttgccccctcgaggttagcactcctctgaggtcacagggtggggataaatgttctgaaggaatcagccttagaaagcacactttttctaagtatcccgaaggaatcaatcactaacgcacatcacaaaattctctccaagttgggaagatggttttagactttctctttcttttctttttttttttttttttttttttttgaggtgggagtctcgcactctcgtccaggctggagtttggtggcacaatctcggctcactgcaagctccaccttccaggttcacgcctttcttctgcctcagcctcccaagtagctgggactacaggcacccgccaccacgcccagctaattttttgtatttttactagagatggggtttcaccgtgttagccaggatggtctcgatatcctgaccttgtgatgggcccgcctcggcctcccaaagtgctgggattacaggcgtgagccaccgcgcccggccagactttccctttctttaagaagagaagggagtgcctttgagaactagagtttaagtaaaggatacatatagcttaagtgcttttatctttgaaatatactatgaccaatagactcgaaaatttcttattgtttttgggggtatcatagtcaatttgggctcctataacagaataccataaaccgggtggcttaaacagcaagcatttatctctgatagttctggtggctgggaaatccaaggtcaaggtgccggcagatttgcctctgccgaggacctgctccctggtttgcagatggctatcttcttgctgtggcctcacatggctgggaacagaaagagtgaggggaggctctcacatctcttcttctagtgacactagtcccattcatgaagcctctatactcatgatctactcacccactaaggtccccacctcctaataccattacactggggattaggatttcaacataggaaatttggggaaacacaaacattcagtccatacgggggaattttcttttttcagaatctgttgtttaattataccttcacagtaacttttgtcaaagttatatttaatttctacttcctggattctgtagcagtaaatggagctcgttatgtgtcccaatatttgtaatactgatttctagtcctagaagtatctaagcctctcagagttaaggaattcggtttggtaataggctaagctaatagccatatggctctgcactgtgctatagagaaactgtgggtttccccccacctgacatctcagaatgaaaaagatcactctgcagaatatttcccacacttctaaccctgatgatttttccactcaacattttacacaaagaggtaggtacagatggtagtttgctggatctctggaatattcagtcttggtcttcactcactccctggagcctactcctcatttttgtataagcaaagtggtttaaacagggtcttaggaaatatctccagtatttaccatttgcaaacctaacccttaatatatggaatctgttagatcaggtttttaactcagtaaacatctttgggtgcatccccgtattaaactaaagaagaagtagaaaactgaaggcaatggccctgttgcttaactgtaaggaacatgtaatttagaaacttcttctctttaacatggaaaactaaccataagtatgtggatcaacgttcttctttatggagtattaggagtgaagtgtcatgatgttatggtgtttttaacggctcagcaaaagaaaaaaaattatatagtgagatgaagtagatatgacaaaatattagttgttgaatctaggtggtgggtatttgggtatacatttttcccctacttttctacatttaaaaattttcataataaagggtaaagcagaaaaatcctaagtgtaaaaaacatttataaaactatacaaaaaataatttcaaggttcattctctattaatggtattggagttggtaggaaataattaaaataggagtataaatccagaagcccgcagaggccaggcaggtaatgtgggtgagtggagctgccgggcattggacaggagggagatggtggggactgagcaaacaggcaagtgcacaactcattgaaagcattccaaaaatttaaaaaatcttaatgctcattcagaatgaaacacttcagaggactggaagtttgtggtctcctaaaaatgacaaaatttaccgtctctaaatttgcccagctttctgtccttctccctcttttcagaagatccaggagaggcgtagctatcaatacgagagggagatggtttcctggcacaagagggtgatgggaaaacattgtgttcaatgcctctagaatttgcctgggttgccacaactttgttgcttcaggaatggaaaatgtggcccatcttcttattttctctgtcctgtcttgctcctgctatgacccggggcaggatttgcggtgggtttatggagattcctatgagtcaaggaagcacattctgaggatagagtcatgcacctgggttttgtttttagatggttagagggaggctgcaattgtgatttataagaatgacttaaagtgtaattcctttgattttgaagttggctaggcaacttaatttgaacatcctagtgtgcctattagacctggcaaccttctcaaaatccccctcctacttccctcgtttccctcaccctccacctttttctcaagaggtagaagtgagagttttgttttgtgagctaaggttgggttctgggccctctgcttcagccacctggcagcttgggctggccctgtagccttcctccacttcattctgcgattcaggctcccaatagtcttctgaagcaccggagagcttcctcatgcaccttagaagagcagattcagactgagacaaggactcgctcttaggcatatatgcagcctacagagatcctgggaagcctttttcctcctaatatcttcctagacttatgctttccttggaattccagcaatagaactgcatactcgtaccctaatcaagaaccttttatgtactaggtgctctactagacatgagataaaaagataagcaaaacgtggtccctgtcttcaaccagctcaccatttgttataccactttaatcaccttagagaaaatttttttttttttttttgagacagagtcttgctctgtcacccaggctggagtgcagtggcaagatctcggctcactgcaagctctgcctcctgggttcacgccattctcctgcctcagcctcccgagtagctgggactacaggcgcctgccaccacgcctggctaatttttttatatttttagtagagacggggtttcaccatgttagccagggtggtctcgatctcctgacctcgtgattcgcctgccttggcctcccaaagtgctgggattacaggcgtgagccactgtgcctggccgataaaatgttttaagatgtgttcggccatatgaactttggtgagaattaaagatgaggtttttacttatggagtagggggcacttgggatgggtgaagaagggagaactgccctgaagttcttactcatagatgaggaaaaacctcagctttttgttaaaatgagtttatttatttaaaaaatatttaagggggaaatgcattcatttggttaaaaaaagttctgttaaaagtatactatgaaattccccctctttaccccttgcctccatctaattcttatatatcatttcagagtttatttatgtaaatataagtaaatctgaacatatactcttgtttacttgcaccccaacccccatttttatgcaatgatagcacactctatgcatctatataccttttaaaaattttatcttatggaggtttttttccatgtaagtacatagagagcgccctcattcttttctttgttcatgtaatactatttatagatataccctgatttaattaacaggccctctattcagggacattgtggtgtttgctgacctttgctgttacagtcactgctgcaatgaatactcttgtatatacatcatttagcttgtgtgctactgtgtgtgtaaattcctagtggtgaagctgttgcatcagaggctatgcatttgtaattttgttatccatgccaaattgccctcctccatagggtgttaacaacttacacactaagcagcaaaacctctttcctcacagctccacctacaaagtatttttcatgcttttcgtttttaccaatttgacaggtgaaaaatgggcttgtggtaaagtttcaatttgtttttcttattataagtgaggttgtgcatcttttcttatagttgaggtattggtatttccttttctgtgaaatatcttttcataacttttgttcatctttcttttgctaattcttttttttttttttttttgagacggagtcttgctctgtcggcaggctggagtgtggtggcatgatcgcggctcactgcaagctccgcctccgggttcaagcgattctcctgcctcagcctcctgagtagctgggaatacaggtgcctgccaccatgcccaactaatttttgtatttttagtagagacggggtttcaccatgttggccaggatggtcttgatctcttgacctcgtgatctgcccgcctcggcttcccaaagtgctgggattacaggcgtgagccactgcgcctggcccttttgctagtttttaatttgccaatttcttttcttgtttttttagagatggagttggatcttggctcacttcagcctttgcctcccgggttcgagagattcttctgcctcagcctctcaagtagctgggactacaggtgcatgccaccacacccacctactttttgtatttttagtagagatggggtttcaccgtgttagccaggctggtcttgaactcctgacctcaggtgatctgcccgcctcagcctcccaaagtgctggaattataggcatgagccactgtgcccagccttatttgcaatttctaggcactctttatatattaggaagtttaccctatgtgatatgagttatcacaataggaggaaaaaggcttcctggggtctctgcaggttttttattttcctcagattttgggtattctttttgtattttaaattttaacttgtgtttgttgtcatgaggagtcttggtttttgtattgttgaatttatcagtgtttcctttatggcttttgcattatcctggtccactgttaatggcacaaaatcgttcattcctttttccatggtgcctccttcctcttttcctctttcaatttcggattgacagcaaaatgcttttggtatcttctcccaagtttgcgttcctggaaatgtatttcttgtcagtgatagggtagcccttgatagttttgttaggagattttagtggtctgtagcattcccattttcttggtacaggcactctgggaaactgacagtttcttataaaactaaacatgcaattaccatatgacccagcaattgcattcttgggcatttatcccagagaaatgaaaacttatgtttacacaaaaacctgtacatgactgctcacagcagacttgtttgtaatagccccaaactggaaacagtccaaatgtcctccaatgggtgaatggtttaacaaactctgatacatatataccatggaatactactcagaaataaaaaaagaattaaccattgatatatcaacaacatagacacatctctaaagttttatgttgggcaactaaaaagattcaatcctaaaagcttacatcatgtattatttcatttatataacacttttgaaaggacaaaattttagaaatgttgaatggattaatggttgccagtgttttaaagatggaaagggggatgagagaaagagtggggtaggtatagttacaaaagcagcacaagaactctttgtggtgatggaacttttcagcatctgaccatggtgatgaatacatgaacttgtgtataggaaaaaaaactaaatacagacacaaatcagtgcaaataaaatgaggaaatctgggctgggcacagtggctcatgcctgtaatcccagcactttggaaggctgaggcagctggatcaccttaggtcaagagtttgagatcagcctggccaacatggtgaaaccctgtctctactaaaaaatgcaaaaattaggcaggaatggtggcacatgcctgtaatcccagctactcaggggccttgttcaattgcttgaacaaggtttcagtgagctgaggagatcattccactgtgctccagcctggaagacagagcgagactgtgtctcaaaaaaaaaaaaaaaaaaaaaaaaaaggaaatctgcccgggtgcagcggcatactcctgtagtcccagctacttgggaagccaaggtgggaggatctcttgagcttaggagtttgaggccagcctcagcaacagagggagataccatctctaaaccaaaaaagggagggatgggtaggatctgaataaggtcagattatatctatgtcaatatcctggttgtgatattgtaccatagttttacaagatgtttccattgagggaaattgggtaaaggggacacgggatcctatacataggatctcaataaaaatttcaattaaaaaattcccaatttctgctaatactggattcaccaaaacatactgcctggaagcaggttcaggtcaagtaactggtgctctcctgtgttaggacttgtagtgcagcagctgagcagtggaatgtggaggagcctagcagtgcctcgggttccagccctgtatgctgctctgtctcagaagatctgagagcatcgaccagcatttcccaggattctctgggacaacctagctgggtagcccttcatacagcctgtctggagggagagaatactggcttcagctctaatatatcagaacagtgtggtgtggatgttggtggttggggacagtgaggggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctcaaaaaaaaaaaaaaaaaaaaaaagctttgctgtgccctgcacgtgacctactgtcatatgtattctgtgttccttgtgctgtagcattggctctgctgtgagacagaatggtctggcatgtggtagggcgatcactgggatccccaagaccctgctagggaatctctgaggtcaaaactatgtttgtaataatacttagacattatttgcaaaacatgctcattctcttacagaagtgtccagtggagttttccagaggctaaatgatgtgaaatagcaacagattaaatgcagaagcagctatgatattccagctgttttctattaaggcagacattaaaaagacattaataaaaataaaccagtggcatcatttcacttttttggtttggaagaatattttccttaaaatgttatttttgttaatgtataaaggggttatcattatatttaaatgatttaatatttaagaatgttctcagttttaatttttataggtgaatatcaaaagataaaactcacataaaagctctttggggtccttggtaatttttgagagtgtagaggttctgataattgagaactgttgatttggcagaaagcaataggcttaatttctagactgggctttgctttgtgaatgtgggcatcatttggcctcttcaattgatttcttctcctgcaaatgctattaattgccctgctacatacctataaaaatataatcccctatgcaaatacaggggagattaatggttacctggctaagctggtgttgaaagaaaatgtaaagaatgagtttctggcctgttagctgacagtctgtttacttgttaaatgtctccattttagcatctcctagcagtttctgtatacatttgatttctttttctcagtttttcagacaaccattttaattatttttaaaaattatattcccacattttcaattaataagggatttatattcctagtaccttgaagtgatgtgataaggtcaggagctctgttcttggagaaaccacttactagctatgtgacgtttggaaagttacttaacttctctgtgtcttggcttcctcctgtgtaaatggagctaataatacctcactttccagggcagctgtgaatacgaaaaatcgtgcacaagaagcacttagcaaaagtgcttggcacataacagatgccccataaataataattgcaacgattgtcattaacatataacaaaagatgcaagattaaattgaagtcttaccctgtcttcagtgaacttgttaaactactttattcacaagtttattagcagtaattttaatttcatttcatttttttctcctttgaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagaggtaatgtgctgcgggaaaataacattgctgactggttgttgtgattctctgcaactctggatgccatcttaagacttgacatttgtcactattgctttgaggagattgctttttcccagcagtaaaatgtgatgatgaaaaaagtggtccacagagctgggctaatttagagtttgaattctgatcaccactgatttgcttggccaagttgcttaacttctctgtctcagtttcctcatgtgaaaaatggggctaatagtagtaacttaccccaagggttgagtgacagattgcttagtaagtgttagctattattagtgcatgtaaagtcctgccatactaatttgctctagccaccattctgtctttgaattgactttaattgtttcctgtgtataatttatattttgtttcccagtagattaaaatttctttcaaagcaggagctttgatacgaaaagctccagtgattcttaatggttttatggaaacaattacgcctatttaacccgcaaagtttttaaaggaaagaagcaatgtaattcatgtgaaagtacttagtaaactgaagcacatgatgcaaatgttgtgtaattatcaatctcagtaaataggtacttcctttaagcacttaaatgtatcattgaccagctgctgcacagcacagttctaggggcataaaggaataagtaagtacattttccaaagtttccagtcaagaaaaactttatattcctgataccttgatgtactgtaatatcaaggaaatgttaggagctgtttactggagaaaccacttctgtgaatggcactcccagatttgtttaacaaagtggccctttaactctggtgagagaagatggacatggagaaacaagtgatggagcaagaatcactgcagattaacaatttgtatttagcaatggaggtagtgtatccttgagattacaaagcagtcattagttatattgacagatttaaatttgccaacacctccaacattttagtgcttagctttcataaaatgttgcatgcatatactcttctctcatgggttaaatactattatttggaaaactattaaacatgacctttgatattgcttttcattgatgtggctttgcaaatattataaacttattttactatattatggtctaccaagctttactttccaaacatgactattcattggcatcatgtgagttttttgtttgttttaatactgagttctcccctcctcccagtaagtctaggtgtggtctgtgaatcattattttaataagatgttatggtttggctgtgtccctacccaaatctcctcttgaattgtagcttccataattcccacatgtcatgggagggacccagtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgtgattgtgatgcctccccagccatgtggaactgtgagtcaactaaacctctttcctttataaattacccagtcttggatatgtctttattagcaatgtgagaacagactaatacataagtttaccaaatgatacaatgccaccctctattacccaggatttgggaaccagtggtcttaagcactatttctaaaataagttctacaaaactagtcccatataaagaggtcaaacgatttgcatattccctcaccaccccttggaaagtcacaaagcgtattatctcacttaaagttcttaggagtctcacaataaagaaagccagacttttgaaacttagttgacctcagaacacttatcttaggtaacatttattaatgtcccataaagtagtgattttagaacattctttgggaaatgctattgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtcctttaagttcaagaccagcctggccaacatggtgaaactccatctctactaaaaatacaaaaattagccaggtgtgatggtgcatgcctgtagtcccagctcctcgggaggctgaggcacaagaatcgcttgaacctgggaggtggaggttacagtgagcccagatcatgtcactgcactccaaccagggcgacagagccagatttcatctcaaaaaaaaaaaaaaaaaaaacgaaaaacaacaacaaaaacctctaatccatatctgttgttttgcagtttagtaaagtgtggtacggagagattaactgactagctctatatcagagagctggggaaagtgttttgtagctggaagtaccagacagagcttctcattatagcacattttcaagacttcagagcagtgtttgtcagccctggttacatgttaaaattactcggaagttttttcctccaatatatatgatgggaaattttacacatatactgaagaagacagggtaaaagaaggcggagtaacacagtgaaccttaatgtactcattaccagccactacaatcatcagcttgcaaatactcctgttttatccatatccccactccctgccaccctcaactgtatattttatagtaaatccccagacattatttcattcataaatatttaagtatatatctttaaaagtgaaggattcttttaaaaaataacttttaaatttgaattaattttagacttggaggaaagtcacagaaataatttgagagtacctatataccctgccccatgcagcttcccctaaagttaacactttacataaccttcgtacaatgatcaaaaccaggaaattagcttggtacaatactagcaattaaatggaggccttattttgaattttaccagtaattccacgaatgaatgactgagtcgttttgaaagatgtagttataatgctgttatacctaaaatatttaacaatgataccttaattcattcagcatagctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatggctcatgcctgtaatcccagcactttcggaggccaaggcaggtggattgtttgagcccaggagttcaagaccagcctgggcaacatggtgaaaccccatctctacaaaaaagaccaagaaaaaaaacaaacaggcatggtggtgcgtgcctgtagtcccagctacttgggaggtgagaagatggtttgagctcaggaggcagaggttgcggtgagccgagatctccactccagtctgggctacagagcaagaccctgtctcaaaaaataaaataaacagtttaaaattctgtttgaagaactttgggattcactttgaatagtcagtaattacccaggattattgcaaaacagagaccagcactcacagtactgagcaatacctcagcagcgtgctcgggcagaggaggtgagtgcagttttggggctttcattggtggcgtaatgtgtccgtcttatctctgttggtgagtgttagcaaactcctgaatcatatccgtccgtctatgttcacctcagacctaagggttgaaattagtcacttccaaatgagtaaagcagaggatgtcattttgatcaaacaccaactctctgatattattccagatgtttcctggaaatttggttggaaagatgaggaagtaacataatgctatgtgttgacaagtgagggaacttaataaccatggagaatatgtgttagtggaagtatataaccgggatcaactagaggtccctaagattacagtacctgtgatcacttaagtctggatcaaagggaaacatggctataactatttctgattcagataaaggaaaatcagagagttagctcagctttccttatgttaaatttggatgatgctcttgaatgaaaagcttatgtttatagatttgtgtatgtgagggagaagaacggaggtaatttactttgcaatcagggagtctagtgacataccttaactactagtttctttaatggcgataggctgacccctcagccagcactgttgagcagctattgcagacccacctagtggggaggtcctttgggggttccagagacatgtaacatggtccttgctctttgagagtttagcctcgctgagggaatgaagatatacagaacagaaatatgaaaaaggcactgttgaaggggaatgctcatttgttatttataactaaagttctgtaagagttaaagattgggatatcctggagcagacggggtttaagctaggtctttgaaaaaaaaaaaaaaaccaggatttgggaaatgagaggaagaggggggcattgctgcaggggaacagcttgacagtcttagaagaaaattaactttggggcttcagggacactgaagaaactggcctgagtttcagtgagcttgctcagagaaatctctgcattaagaaccacagaatgttggaattggaaggaccttagagaccctctggtccagtgctctcattattcagatgcagaaattaaaggcttttacagaaagtaagcacttcgcccaggtcacacagtgaggtagtggccaaaattaagttaaaagtggatgaagatcaaaggggattttttgttatgcaggtggtgcacttgaacatgtttacaggatgagggggaagaggcagatgagacaagatcaaagatgaaggagaaagggggattcttagagcaagatccctgaggaggcaagagttggagccttgtgggacatctgttctgagagaacagggaggacgcaggcaagtttatgacaggagggtccctggcacagatcggtcacacccagcagcttgtatcctctgtggagaagagggaggtcatttgttgagtggtcatggtgactgggtacagtaatgagtgccattaggcattgagggctcagctgaggcagggcaacttgtatttgctctttgtatttgcagacaatttggcagaatggttctgagcgtaaactccagagccacactgccaaggttcaatcctggctccatctctgactacctgtgtgacctcaggcaagtcccttaattcttctgagcctcagtttccttttctgttcagtgagaacagaatgacatccacctcaggttttcgtgagggttcaatgagttattcttggtacagttctagggaccacgcctgccatgtagtagacactgtagtgttagctctttgttattgctttaaatataaatgatgactaaggagaaaggcctatcctaattgccatgaattggcccatttgaaattacttgataccagcagctgtctaaatattgccccattttaagttctgctcttaacaacccaagtataagcactaaatagaggcaaggcaaaaaaaaaatttttttttttttaagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaatacgcagccccaggaagatgcagcacagacttttggagcttctcttgtcacttccctgggtcttacttctgcctcattctagttgctgtcagtgggtaaatgtgttcatagattagaacaagttgcagcacagacttttggagcttctcttgtcactgccctgggtcttatttctgcctcattctagttgctgtcagtgggtaaatgtgtcatagattagaacgcctttgtaactaagataaagccacaagctttattttgttacagttcctgtgtgcttgcttgaaggccttgagagtacattcatgatatgattctagtaactcctgttttaattcttagatgtgttgataagcatagtgtattgacataaaccagtatgaagcatggagggggttcagatgaactggtaagaaaaacttgcaatccttggaaagccatatgattacacaggattatgaagaggccctaaggtttctctaatttagccctttcattgtgcaaataaagaaaccaaggatcttcgagtgtatatgggatttgctgggtatctttccattagataatgactaagatggtattagaaggtgagtcatcttttccactgcaccatactacttatgttctgcctctttggagtccttcatttcatttttggttattcctttttttacatggtaggtcctcaactggtgtttgaaggaatgcacgagagttgccattcatgggcctgcacacagggctgggcagggatttctttctgtcatcggtaccgtaatgtttaagacccagctggagtcattttccaagtatttgacctgacttcctgtactgtgtgtcctcccagggagagagactgatccagattaaatgagtagttccgagtgttgcacagagcatcactgtctgaactggcattagcattcactttgagctcctttggttaaaagcctggttagcgtgagctgttggccaggtgaaactgttgctatcgccctgacactgtgaaccgaatctcctttaaatgacaacattgttagagtcctgtggccgcttttaaatatattttggcttcagttgcttctttcttgacctgaaattataaaatgagttgggagtacctattgcaaagctgcaaattttgacaagaacattgagatgtcggcttctttttgctgaaatcctgaggcaagacatttcaagaaaattttatgttcccatagaatgtcacaagttactctggcatcaattccaggttgaaaccttacagtgtaattatagtttccccccttcttgtcctttgggcaacctttcttttctgtaagaaatacaactggtcccctgggtggcaggaaatccaggtgggggagtgggctgcttctggttcggcggactgtaaggtatgctgcacagggcttccttgggcctggccccacacttcctttgcaccagcactgtcctgccaaaagccagaaatcctggaagagggccgaatctagtttattacttgcctgttggaaatgtaggcttgtgttttttggcaaggcatgagcagagcccggttatttgactgctctgagatttaactccattccgcttttggacaatgacatatgagcatgtgtgaacagcagccccatttccccccagtttgcctgccctagacatgccctcagacagctggctctgccagctttcccagtgccaggttctagagcccctgttcttctccctcccctgctcatttccagtccaccagagcgggcagtgtcagaggtcccatgcagcctcctctcttgtgaggaaccccagagcacctgtagtctctaagccaactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccaccttgctgatagtgtccagtggcaaaagggaaaaaagagtggactagcacagttaggaggttcttacgggccaaacctatgagtgttgcctatgacttcggctagaactcaattacatggccacagctaactccaaagaggctgggaaatacagtctattgtgtgcccaggggtacactaaattttgaacatctgtgtcatcttcgaacttagattcctaaaatgcatctgcagcccagctttgagattcagaaggcctgatgcaaggttccatggtaaattttgcttggtttaagtcctcctgccaatgaaaaccaagtgacattaggaacagatctaacaataagttaaaaaaaaatcaagctataatagtttatattcaatatgatttcaactgtgttaaatattctgtttgtttattttagagcagggttgtccaatattttggcttcccagccacattggaagaattgtcttgggccacacataaacatattaatgctgaggatagctaatgagcttaaaaacaacaacaacaaaaaaaactcataatattttaagaaagcttacaaatttatattaggccacactcaaagctgtcctggactgcatgcagcccacggccgaacaatcttgttttagagacagggtctccctggtctccttctgttgcccaggctggagtgcaataccacaatcatagcttccggtagcctcaaactcctgggctcaagtgatcctcccacttcagcctctcaagtaaccaggactacaggtgtgccacctacctggctaatttttaaatttttttgtagagacagtgtcttgccatattgcccaggctggtcttgaactcctggcctcaagcaatcctcctacccacctccccaaagtgctgggattacaggtgcgagtcatcgtgcctgcctatgttaaatattcttaataaatgattagacagaaggtaacatgacagtgacttaattgtggttgccctttagagatgagattatcagtggtattttgttttagcctgcttctgtttttctgtattttacaagatttctatcttgaacatgcattgctttttttttttttttttttcaatttgaaatacctttttttttttttttttttttttttaaactgatgggtaggctccatcttcagagattctgagccagtgggtctggagtagggcctggtacttgctcttttattttttaatttaatttttttacagagagtgtcttgttctgtcacttaggccagagtgcagtggcacaatcatagctcactccagcctcaaactcctaggctcaagtgatcctcctgccccagcctccccagtagctaggattacaggtgcgtgacactatgcccagctgactttaattttttttttttttttttgtagagacagggtctcgctaggtttcccagactgaccttgaactcctggcctcaagcagtcctcccacaatggcctcccaaatgccaggattacaggcatgagccaccatacctagcttctgttttgttttgttttgttttgttttctcacagtatgtgaatctcataagagttccatctccctgcctgcagctttttgactcaccaggataggaatatgcctctgagaactttttacgcacatgcctttacatgtctgcttcatttatgaactagtcagctctgtgtcaggccctgttgtaggtgtcgaggaaatatcactacaaaacagacaagaatccctccttcagagaccttacattccattgtggacacagacaataaacacggtaaaaaaataagatagatggcatgtaagatggtaaatacaagaataaaaaaaaaaagtaaggggatataaaatgtcagtagggtagaaattttacatggggtgacacagaaggccttcccagaaaggaacttttaatataaagacctgctggtcagtacagagctagccaggagactcttctttataactctgtctagatctgaaatttatcaggttatttgaccaatggcaaccccaaatcccaagattctgttctttactatcaccctgctcactgtcgtgtttatctgaatgttctgaactagagtcttatttgctatctctgttgttagttggtaggagacttgcagatctatactccttttaaaaacatctgaattgttttagatctcagggactcccaaaggatttcatcaggaggtgtccctaaagcttgaagcagcatttaattttcttctgcccacgttgacagactgactatagtattataagactttagttgacgtcctggcgatcctccatagttttcatttacacatgagtagagagcatttcacttgtctaaggtcctttcacaccattgctggaaactgcccatgacagccaacctgcagcccagagcaaaaggcataatgaatgtggaaggactctgcaggaccatacggagctatgtaaaagaaaggattattttgggggtgtaagagtcatttatatcaaatgcagccagacaaggagggattgcaaaatgttattctgtagaagtatgagcattagtggcgtaatacagcatcattacagtgatggtttcttcctgtatcccaaagtcccccagcctcctctcttcccctttctacctggaagtttacgaattctctctttgcccttgctgagacttagattctctggagtctgtcactcacctgcctctccatcagatattgtaatagtcatagttgtattctgcaaaatccgtgaaattcacatggctctagcctgaaatgtccagcctccactcctgctccctgacttctgctgtgccccctcctgctggtgtctgctccccttctctgcctgaggaatcctgctctcccatcagcaaccgccaacatcctggcacatgcagaggtcccggtttcccttgatcacaagggacctccttccttatgcctccctggtgcacaggaagtgtttgctggaaccgtttatgtggtaaagttgagtcggtgcctcagccatctgcatgaggaatgacatgggcctctggactctagatcaggctccagcctgatgtcccgagcagccatctatcatcctgcccgggagcacaaggcagccccagtggcagtataccaaatcattagaccaatatcatcattgtcccatgtgcggtatcttggttctttcttcaggcacggggtggaggattttagctgtaaaatatttacccacgcaccactgctaagctctgttctctgagtcaaaaaggggttgtgttcacacatggtttgggtgcatacacgagggaattacagagcacatagtccagttttctattgtttcattaccttagctgaggttttaagatgttaagtgtgtcactttggtcacacaaacttacttttacctctctttaattctggacatcggaaaagggagtccaggttagtggcgtggcttggagcctttccttcactatccacctgctgcatctgtggaggcttctccagcccctcacctgatgtggtagtgacagcagcaataatgttgcagctgtcgtttttacatgtttaccatgtgccaggtctagaataggcattttgcatatatcagctatatttcacgatcagctgagattcagagacctgaatgtgttcccggttacacagttgtcgaagtggagctgggatgcaggctcagagctaacgtccaccttcgaaactctaaagccgcgcttcctttccacctctttgtccattgtcttcaattcttttatttttatttatttatttattttttgagatggagttttgctctttgtggcccaggctggagtgcagtggtgcaatctcggctcactgcaactcctgcctcccgggttcaacggattctcctgtctcagcttcccaagtagctgggattacaggtgcctgccaccacacccggctaatttttgtatttttagtagagatgagttttaacaatgttggccagctggtctcgaactcctgacctcagttgatctgcccgccttggcctcccaaggtactgggattacaggcgtgagtcaccgtgcctgaccttgtcttcaattcttttttttttttttcttttttttgacagattttcgctctttcgcccatgctggaatgcagtggcgatctcggctaactgcagcctttgccttctggtttcaagcgattctcctgcctcagcctcccgagtagctgggattataggcgcctgccatcatgcctggctaatttttgtatttttagtagagacagagtttcaccatgttggccaggctggtctcaaactcctgacctagtgatcctcccgcctcagactcccaaagtgctgggattacaggcgtgagccactgtgcctggccgtgtcttcaattctttaaggtcttattctttcatcctgtctcctgctcatgcccaatgttcaagcatgttcccttaccctgtattcctttataatactcgctgcatagtgtcacagtatacttagcatctcaaaagcagtctttataggatgcaaccacactttaaaatagccctgaagaccccacatttacgttcttgaagtggcaactccgcctaccttgcaggtaacttctttatacttccaaccgtgctttggagaatggggctttttaacagtgtctcagaggactgtggtggtacagaaggtagacagagagtggactcatgcctaggagcttcatccttccccactgccactctggaggggttgcagagagggagcctcgaattagtcagaaagggctggggtgcttggttacagacggggccttttccaggaggcaaaagatctcagatgtctacgtgccctacaccgctgtctttcatgggacccgaggaaagctctcccaaggaacgggaggagtgggacttctgtccctcaggcttttatttttacttgtgatgtttttcttttcctggtttgctgccatcaatgccatttgcaaggccttttgtggggaggaggtataatctgcctgtttagttttggaagctgcttaaaggttttaggatttctgtcccactttcccacctagacgtgatgccaagggtaagaaggcatcggggaaactgggcaagtcgtaaagtaattattggaacagtcatacaattcaaattcctgccgttctgatatcgcttaattcttttgaagacctgaataaaatgtgttctttttctgagacatttagatacattgtttgaacaaaggaaacagggtgacttcaaaatgtccagtatgtggaaatcgatgccgttcagcctgtggtgtaattaatgaaaacattggcgacagtcggcctcattgtttgtcattgtgcaacaggaggtggtacactaataaggagccggggaaggtttacgtaattcagaaggaagcagacgtgtgcagttttgactgatgcccttctcactgcagatccaggctcaccgagcaggttcctattcctgatggacgtggagatgtctgattggattttgtcatttgatttttgacactgattaatgatagatttttatttcccttatggtcagaaataattgtcttgaaaagcttcactttagatcatagttttcacacacagttataattcattgggtaaagcatagtagaacaaactatggaaaaggaaatgtcattggtagactttggtcgcttaggacaggtgtggtggcccttggaatcaggagatctggagttctgtcctggccccatcagtcccagctgtgtgagcttagggatagtgcttgcccactctgggagcagccttcatctgtaaaaggagggggttgctcaggacccttgcacctccttccttttacagatgaagattgctttgtctaagcccccttggtgaggtcaagaattgtgaaatgtttgtacaagtgagatgtcaagagtacaaaatgtacagacgaactgccagtgaaaatgtcatttaagtttatctgctaacagtttattccctttggtctcctctcagtttttgttttgtaattgtccatgttttgtctggtaatttattattttttttattagaaaagtaaacaccaaagtgtttttccattccgcttgacagcataacaaattgccatttaaattcatctcttaaggatttcaaaaaggcattaaacacactgctcaacatggtatgtatttaattgaaatgagctgacttttgaattaattagctctttagaaaaaataggcaaaaatggagccgaaaagcatgggtttgaattctggcttcactgctagtacgagctgtgtgaccctgggcaccttttctcatctctgaatctctaatttctcatctctaataggagagggacactttccctatgagagtgtggtgaggtataaagataatgtatgtaaactgcacagtacagtatctgacagttagtagatacttaatggatagcagctgtaactgttatacattattttattacaataattaaaataactagagaatttgtgtatattatatactgggttctatctaccaaatcattctaatatgatgtgcattgattaccaaaagaaatagtcctccagtatggatgccagttttgtttctgttagagtgtgtggagtgagatttaccagagagggatttctcttttctggttgacagatcaaaggtacgcctatgagaatacatggcaagaatttattcttttttttttttttaacagtgataaaatatactttactttgttgagtcagagggttgtaaaaaaaattattgctaaagtaggtatcaggcaaacagaaaggtgctttagaagtccagttaccttggagtttatttaaactaagagaaaaacgtcataatgttttcatgcgatacatatctggttctttaacaattgtgtgacaaacagcagaaggaattaaggaatgccgcacttgtgatccatacaaaacaccaacactttaggttgtacataattaaagaaatatctcaaacactttttaaaacactgtagtagccaatacatagaggcatgccgtaggtaggcacaggaatgcagtttagaaaaataaataaatcacataggaactactcaatttccttaaaatcactgagcaagaaaagcaacattgaactggctgggcgcagtggctcacgcctctaatcccagcactttgggaggccgaggcgggcggatcacgaggtcaagagatcaagaccattctggccaacatggtgaaaccccgtctaatttttgtactaaaaatactaaaagtactttttttgtactaaaagtacaaaaattagctgggcgtggtggcgctcgcctgtagtcccagctactcaggaggctgaggcaggagaatggcgtgaacccaggaggcggagcttgcagtgagccgagatcgcaccactgcactccagcctggcgacagagcgagactctttctcaaaaaaaaaaattaaaaaaaaaaaaaaaaggaaagcagcattgaactttcatattgattttacacagcttttatacagtaccttgacttaaatccaagagcaaaacttgactgtcctcctctatttttggtaaacttacgtgactttcccccctggattttacctgggagtagcctttttaaatttttatttaaaagagggcaggtttggcactttatagtaatgtcaccaatgttaatatttcttgggatctcaggaagattcacattttttacagctgatacaggttcagcacaggctgaagctccccctcagccagcctcagatttttccagcttattttgtgcaccaatttgtgtaacaatcccattcatgtttgtctccaataccattcccccatcatcatttctgcaagaatattgtgaaccgtgtctacatggaaaatcaaatccagttcacaaacattttcaaaacatttgtctaatgtttccacaaatccatagggctggtagaacttggagagccgcggtttcccatgattgttaagattaggatcgccttgatcgtggctgggtcgggcccaccgggtaggcactgggggccagggtgcgggccggcgcgcaagcctcgcctcgtgatcttgccggcgatccttccccacccactccctcccgcacgccggcaagagtttattcttacaggctgccattgcaaactactgtcttcagaaacaaggtcacttcaaagtgtccagaatgtggtaattggtgccattcagcctgtggcgtaattaaggaaaacatttgcccattgttgtccattgtgctagagagaggcgtccaggaaagattcatactcccaaaccctccatgggagtggtgatctggagagggtcggacagccagaaagcacatagttgaccctgaaaggttttgttgcagcctgtcataccctaacctttataatctgtctgaatctctactgcaggtcaagtagccatggtctggtggggatagaggtggcaggtgggctagaacgtgccatatcttgatttgtggcaatgggcctcctactcttcggagtggagacagctaataccatgagtcaaagaccaaatcgggatagccgatgtataaaaacacaagcaccgggtttgcaaactggaagaaaggtcttgaagaaggtgtcagaagcaaaaaatggtaagtatgtgaggaggtggatattttaattagcatgactatagaaatcatttcactatgtatatgtatgtcaaaacatgtgtgctgtaaatatatagtttttattttttaaaaaatgaatgctgtcagtatgagtccatttaaaaataagcaggcttaaaggttcaaggaaattgctgagaactggcatctcacgcttccttttggggttagtcgatgcatggtatggctaatgtaaagatccaggatcttatgaacacagctttttaccttggactgttcctcttgcagactcagctaccaccttcctttaggattaaaaatgttttacttagcctcaacaatttgttttagagccactttcatagtgcctagtcctggattcccaaataggtttcttcatcttcgtaaactcgaaagtggccatctggggttcagtgtcaggaagggttctgagtccaagtcagatttaaagaataaccatgatgcattactggtatctgtcgggggtctgggagaaggaattgaatgtatttgaatacacttattttattattttttaaaactgagttatcattcacgtagttcacccttttacagtgtgcatttcagtggttttagtattcttgcaagattgtgcagctacaccactatgtaattccagaacattttcatctgcctagaatgaaactctatgtacatcagcagtcactccccatacctctattcccctatcccctggcaactaccagtctcctttctgtctctctggacttgcctgttgggggtatttcatataaagggaatcatgtgatatgtggcccttgtgtctggtttcttttacttagcataatgttttcaaggtttatccatgttgtagcttatatcagtatctcatatctttttatggatgaacaatattttattctatgaatagaccacattttgtttatccatttttcagtggatggatatttgggttgtgtctactttttgcctattatgaataatgctgctataaacatttgtgtacaaggttttgggtgaacatataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatgaatattagccattattatccccacttttaaaaagtagaagctgagagtcagcttgtgatttgcccaagttcaccaactagtagaatttaaattcaggccttctgacttactttgttaatggtaatgaattattagtgatgtcagggatttgaagggtgagcttacattgctaaaaatcagcaatatgcccatcttcaaataacagattgttactgacttcagaatgtattatttgaatagctgtaaaacaggatgaattgttacttttccatttagcctctttagctacaaagtacttacaataaaagagcagaattacatatcactgcctgctcattacattttgaacccagaaggaaatccacccaaagaaagaacaaagctgggaatggatttagaaccctaaaaagaggcagcctttggttagctgaccttgaaccatccatcatgcctcctcctcccagcctccatattcctaaactgacatccttggggaacaggaatttaaatgtagaacgagtgcagagaaagtgagatatctattgagatcaaataaaaattgaccttgagactaacattaactgacagacaccacattaaaagctaaacattacctttaaagggtgggaaagatgagtgactttttaaatgccgtcttgagctgggcacagtggcttacgtctgtaatcccagtactttggaaggacgaggagggcagatcacctgaggttaggagttcgagaccacctggcctacatggtgaaacgctgtctctactaaaaatataaaaattagccaggcgtggtggcacacacctgtaatcccagctacttgggaggctgaggcaggagaattgcttcaacccaggaggtggaggttgcaatgagctgagattgtggcactgcactgcagcatgggcaacagagtgagactcggtcttaaaaaaaaaaaaaaaagcagtcttgattaagtccatatgcagtcttttttgtttttaacatttcttttaaacttaagtattttggggatagaaaaataagtctattgatcatatggatgtgaattttgttaactgtgaaacacagcttacctactcatttttcttttgaccatgagggttattaaatttgcttttgatcatttcatgcatatctacatcttaagtttttagaatttaaaagttgtacactatctttatgaagttcttactgttatgttgcacatcttttctaacttaaaataagcccttgtagtatgtcactaatttggaaaatttacctttactttgaaaagaactacatcaagcatagtgaggccaggtgtggtagatcatgcctgtaatcccaacactttgggaggctgagcgggtggatggcttgggccaggagtttggagatcagccagggcatcatcttgagaccccatctccacaaaaaataaaaattagccaggcatggtggcatgtgcctgtagtctcagctactcaggaagctgagatgggaggattgctcggacccaggagttcaaggctcccgtgagctatgatcaggccactgtactccagcctgggcaacagagcgagaccctgtctccaaataacaaaccacagtgacatctttcataggatgacccatctgcctcaaaccagcatcaaagcttattttatgaggaaaatttatataacaaaagtttttgaagcaccgtactctcttgttggagaggatatcatttattaaagcttttggttttgctttcaaaatattttttgaaaaatatacatgtacgcatgtacgcctatgtatttttatttttaccatattggatagcatcaaacagtggtaatagttattctcatggctaaacatatagattaaaaacacatggaaggacttgtaggtaaataatgatttcagttattacgtagtgcgaaatgattctatcaggaaactgtgggatgagtaatgtgactctgctgtaagattttcagtagcagaagtacagaacaaaaataaaacatgtcagcaaaaaacacaatggtaagttgtcatctgagtgattgtgtaagccttgaagatagttaatgtaaccgagatgaggcgtccacataagctcctgccttcacaatagatatgttgtgtctatttggatatcacaaaatgtcattcggttttttattctgctttcatgtactacatttcttatcttgctttttcattcttcatgtaaaagaggtttctagacagagtttctgtttcagttcacatatattttatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggtcatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaacacggtgaaaccccatctctactaaaaatacaaaaaattagctgggcgaggtggtgggcgcctgtagtcccagctacgcgggaggctgaggcaggagaatggcgtgaaccccggggggcagagcctgcagtgagccgagatcgcgccactgcactccatagaagctctctcccctccccacaaactctgagtcactcagcttgagctcaggaatgatttcagatgtctaaacaggtcatttgcagggtctgggtagtctgcccacagaggaggtaaaagctctggctcaatcttgaaccattgcaaatttaagccagtggatctgaaggcaattgagttctgttctgccactccagctcaggcaggacagctgcttccctgaaacagggccctctgaggttagatgtacagcctcagtgggcatcagtgtcatgaatagccgctcctcatttggcagcagtaactatccagagacaaaggataggattcgggataaccgtggtcataagctagaagtctccagagtccttagaggaatttgaaaactgaacagaatttttttctttccacactgtgtcagggctttagcaaaggagttctgttgtgacaattgtctgggtaacatctgcctactgttttttgttttgttttgttttgttttgttttcctgatctgtagtccatcttgcttaacagtgcccaagggcacaagcttcacactgttaatagttttactcttaacacctccttggctcctttgtcccaagaaggtgagatcccacttccaggtgatctcctgcaggacttttccctgagcctctaacccatttctagcccatatttccccctcaagaacaataattcagtaatgttttcagttctcctgaaacaatcccaaattttggattttttcttaatgttgaattataagagttattgatatattcattctggatgtaagactgtcatttgatatatagtgaaattttttctttctttgtttatttttgcccattattttcatagggaataaaatattatgaaatgttctcagtctgctgcttgccttttcattttatttcttttcttttctttcctttttttttttttcttttttgagacagtctcgctccgtcacccaggctggagggcagtggtgcgatcttgactcactgcaacttctgccttttgggttcaagagattctcctggctggccacggtggctcacgcttgtaatcccagcactttgggaggccgaggcaggtggatcatgtggtcaggagcttgagactatcctggctaacacggtgaaaccccatctctactaaaagtacaaaaaattagctgggcatggtagcacacgcctgtaatcccagctactcgggaggctgaggcaggagaattgcttgaacctgggaggtggaggttgcagtgagtcaagatcgcgccactgcactctagcctgggtgacaaagccagactccgtctcaaaaaagaattaaaaaaaagagagagatagtctcctgccttagcctcccaagtagctgggattagcaggcatgtgccaccaggcccgactaattttgtatttttagtagagacagggtttctccatgttggtcaggctggtctcgagctcctgacctcaggtgatccacctgccttggcctcccaaacttctgggattacaggcatgagccaccgcacccggccttaatggtatctttttaagagaagtttttagttttgatgaaaatcaatttaaccatttttattttatggttaacactttttgaaacttagaaatctttgcataccccaaggtagcaattttttttttttttaaagacagggttttgctcttgttgcccaggctggagtgcaatggcataatctcggctcactgcaacctctaccttccaggttcaagtgattctcctgcctcagcctcccaagtagctgggactataggcatgcaccaccacctccagctaatgttttgtatttagtagagacgggatttcaccatgttggtcaggctcgtctcgaactgctgacctcagatgatccacccgtctcagcctcccaaagctctgggattacaggcgtgagccactgagtccagccaaggtagcaaagatttttctcctatattttcttctagaagttttatagttttagcttccatatttaggtctgtgatccattccatattaatttcttgtgtatgcactgtgagatgtaaggctccaggttcattctttctctttgtggatatctagatattctagcacaaattgttgaaaaacttttttcccccattaaattgccttgagatctttgtaacaacaataaaaaaatcaattaacaatatatttttagatcatttttacactgtcttttgttttatggatctgtgtgtctctatgccagcaccacactatcctgattactgtagttttatagtaagtcctgaaatcaagtactgtaagtcttcaaactttgttctttcaattattttggccattctgtgtactaagaatcagcttaccaattcctgtaaaacaatgccttctagactttttacttggattgcaaatgaacctcttaatcaatttggcaagcatcagcaccttgaccgtgttgaatctgacaatccatgaacatgatatacttcatttcttgagatcccttttagtttttcagagcgatgttttgtaatatcagtgtacagatcttatacatattttgctgaatttttccctaagtatttcatgttgccgacgcagttgtaaatagtattcttttattccactgtcctgtcattcattgttatgtagaaatacaattgatttctgtatgctgaccatgtatcttgcagccttgctaacttcactttagtagtttttagtagatttttaaagattttctaagtgtattatcatgtcatctgcagataaagacccttttgcttattcctttctaatttctttgccttttacttaatttattgcattggctactgcatatagtacaatgttgaatagaggtggtaagagtgtagacatgcttgccttgttcctaatcttagggagaaaagtgtctttcaccaataactgtattgtcagctggaagtttttcatagatgcactttatcaggttgaggaagtttccttctgttcctactttgctgaaaatttccataataaatgcatgttcagttttttgagtgctttttcttatatccattgagacaatcatagatttctaacctctattctgttgaaatggcaagttactttgattgatttttcagatgtcgaaaaagtgtgtctccttgacataagcattgcttggtcataatgtattatcctttttgtatatttctggattttatttgttaatattttgagttcatgtactgagtggaccagccaagtaggcagatgggcccgcaccatccatataaggtatttggaacaactttgagcacattctacagatgcctaataaccttagtgaggcctgcagttctatgctcaaataacctccccttctttttcacttgtcctttgaaatggactgccccagagatggtatatgaatctgtagggcaaagtttgaagtatgagcttgagtaaatgatgagttccttgaagacaaaggctttattgcattcttttttttttttttttttccccctgggatagggccttgctctttttttccaggctggagtgtagcggtgtgatcacagctcactgcagcctggacctcctgagagcaagcaattttctcacctcagcctctggagcaggtgggactacaggtgtgttccatcacacctggctaatttttattttattttttgtagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttgaaaatcagctagtttattcatttaatttttcttaagttcctgaaacaaagttatttgcaatttatatgtttctgggcctgagtttcctggaatagtaaagtcatgttaacagaaacagtggaaaagaaaattcatgttaatgtacacggtaagctgtgtgggtgtaagtagttttggttctcaatatctatcctaggacctcgcatagtgcatggcacatggcacgtgatgctactcaataactgtctgttgcctgtgtggtaatagctcacacttacccagtgctcactgtgtgctgggcaggatgataatgttctccttgcagaatctcatttaatcctcaggacagtcttttaagtggccactcttgttatccccactaccttgcagatgaggaaaccgaggcttacgtatattttcattcatttattcaacaaatatttattcaggacctgctatgtgctgggtactggagatatagcagggtttaaagcacaccaaatccttgctctcatggaatcagccttctgggtaattttctaaaatcacatagatactgggtcgagggtagcccttaaacctaggtggtctgactcctgaacttgcaatcttaaccgttgttttattggtagatgaatggattgatgagtgtggtgaacaaaaattgtgactatccatttcacaaacagcttcgtggttgccctttagctccagcttggatggttagattgccctgtctgaagctggatttattttattttatttatttttggagatggagtctcgctctgtcacccaggctggagtgcagtggtgcgatcttggctcactgcaacctctgcctcctgggttcaaacgattctcctgcctcagcctcccaagtagttgggactataggcgcacactgccacgcccggctaattttttgtattttaatagagacggagtttcgccgtgttgcccaggctggtctcgaactcctgagctcaggcaatccgccctcctcagcctcccaaagttctggtatgagccaccacgcctggccaagctgggtcttttgaatggctatgggtgctcagtgaggcaaccctaggtgatatcataacacctctgcttatccagaagacaattagtatatatgttatcttgttagaatccatgtgccaaaaatagaaataggaaaggcaaataaggatatatccctagattgtcaaaatggtgattcagaattgtgtgagatactggtttactgcctacagtcacatcaaatgtgttacaatgagcatgtgtctgggggttcgtggagtaaaggtagggattatggatcaaggacaatgttacctcaagagcaaaggtcagagacatcaaaaataggcatcaacagttttaccatccttttccagatagtccattgttgcttgcaccaagttgagactttctttgcaacaaagaatgggggaaacatttaaaaggtaataactttccctacatgtgatctagtcttctttaatgcagtgccacgtgccaacaaaagtctcataaagcaccagtgatacagggtcttgctcaggaaatatgtgtaaaagaggggagctgctggacttcggagagctggggtccagtgtaggttctgtcactgtgagatcttcaaagtcacgcaaactcaagtttcctcttgcggtttttttcttccatggagcataatggaagtaagacatgatgtcagcacgcatgaacaacctgtttgaactcagtgtgctcatctcagcattaacagaaagtgcctttacaaaagctttggagacattaaacacgggccccagctggatgtggaaacatgtagggaagtacatgccatttgacaagtacctgtgaagatggctgtgaacagtcttcatcaggtgtgaatcggggatggattgactgccaaggactttagacttgataagttagagccttggaggccatttcagatagaaactcttcaagcatctatctagtctggtagggttgcggggtggagggccaggaatgccctgccaagtaaaatgtgatgcccgagaaggttcccaattcaggattccacctggctcccacgagccccgctgtctctcaggtgtgtggagtgtttctcagtgctcattgcaaggccaccctgaaaaggcccagcgggtgactgtcaggaccacaggactctcctggctcactacttccaaagtgctgagcgccagacagggctgcagagaaccccggaaagtgtgcattgtttccacattatttggagtttctcactcccatgttttttttttttttctcttctccttctccccgtgcccaactagctgctcctcctgccctgcaggcactcaagcaagaggcccgccagaggacagcaacactgatgtgcttcggtcgcctcccgcccctcctgccctccccacagatgatagcaaaagggaaattattttttcttggggctggctttggtcccccgtgttttcatgagtttgtttttgtgtctctcgaagccattttcagaggctctctggtaccgggtgttgagcccttgtcctgatgcaaggtcgggaaggggcgtgctccaggaataaaccagaaggaagggctggaggagcctgggaaccttgggataggagtgtgggcctcagtagttgagctgttttctcctggcctgggaaagaaacaaggggtgagggggtggaagtggggtccatgctgaggaaggggtgcaagtgcccaacacgatggcggtctctctctctatttttatctgggtgatgggtactaaagagcctctgtaaggggaagagaagaagtcacgcaagggcagcccagagcccgcagtttctttaatgggggagaagggcacatgagatagtcctcacagtttgacaaatgtggtgtgttgtaaggacgggagccttggttgcatttttggccctggcagggagagcctcccttccattgcagtgttccccgagtgtccgccaaactgcagccgtccagggaagagaaggattgagtgaagaacatgcattttggggtttgggatttttgttattgttgttagaaacagggtctcactgtgtcgcccaggctggagtgcagtggcatgatcatggctcactgcagcttcgaccttctggactcaagccatcctcccacctcagcctcccaagtagctgggattacacgcacacaccaccacgcccatctgctcctagtttttttctagataagcaacctgagacacaaaggataagcattagcagctcatacacgtgacagagccagattcagccttggcctgactgatttccacatccagaattcccctcatatagggagatagaaatctcaggatctcaacaaggtacaaataacgcacattcccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaatttaatgtatcttggctaaacttgatctgattctaatcttggtttgagacagggtcttgtgctgttgctcaggctggagtgcagtggcgcaatcatagcacactgactcctcaaactcccgggctccggggatcctcacgcctcagactcctgagtagctgggattacaggtgtgtgccaccaaatccagctaattaaaaaaaattaattaattttacattttcaaattcaaaagaataatacaatgaatattcatatttctttcacctagattgacaaaaagtggtatatttaagacatcaccatcattgtctttcttctggagtatacagaacctggttctgaacacagggatatgtttgtagcttcgaggaatgaagggctgtttacagagctacaaaaatagcttaggtgccattatcctcactgcacttaatacaggtgacacatgaaagcacagagtgggtggcagttcaagcctgcgagggccgagcctttccactgctgcagctgttagtggctggcacagggcaggatggcagacctagtgcagcacaaacaaaccacgcagtcagccagctctccagccaactgtgtctacttctaaagtagaagttagacaaaacatggggttcacttagactggggtcctgagtaggtgataggctacttattactgggtggaagcggagaagtatggcagaagaacaataggcaaattcaatactcccggaaagaattctagttagtttaatattttgatggcatgttgtggtttctgcagtgtcgtgaacttggctaaactgaactgtgttcccagaattcccttccttgtttgtttctctggtgagggttggccacgagagagatttgcatgaggtttggaagtggaagtagagcaacagccatgtgtattcactggaagtggatgtaggtcaggccctgttccatcacgtgcacgttaccatggatctcctgcacttgtggtgtgggcagccgctgggcccacggctcctcccactcccgcagaactctgcctttggcttttccagaccctgggccgggtatgagaaccagcttcttggtctgcagccacaaggatgaaggtttggggatgagagaccagcacgggctctgatgagagacaggtgcaggtcccagcttgtggcttgcaggtctcagtcgtacttgctctccctcaccatcctttccaaccgcctggcctgtggtctggtgaagaagaaacagccgaaccgagactttcaccagcccctctaattgctcaaaccgctttcacaatcctctctttctacatcattcctagtggttcttttctgatggaacctctgactggtaacatggcattaccagtcctttccctctcatgttttgctatttcctgatggaacctgggagtctgagtgatttgtatttcaagaagcagttatgctggatctctttgttggttaataccccatgacctatctggccgttatgggatatttcagggataggagttgtgaaagagcccttggctggacgtttctagccttaatctttggcaagccatttcatttccctgagcctcagtttccgccttcctacagcgtgagcaggtctgggtgggctctcaagcccctttcagctctaagattccaagtctgtgattccgatacatcttgactacaatgagcgtgtttaccttttgtctctgagcagtggccctgggtcttggtagtgactaaattccgagctcccaaggtgcagctgcttttcttccttttaattataaattagctgttcattggctgcttctttctagagcctgttttgcttatcttgcaatctgttcatttctgttgatgaacacagtcaaataggcctctatgtgcagtctcctggtttccctggtcaaagtggaaggttggtagaaactggccttcatgtctttgtttccctcaaagttttattcttagtaacgctatatatggttttatagaccacacatatatagtttcctgtgtcttagatgataacatccttaaaatatgaaatatattttgaacctagatacctacccagtattctctgcacagagtaaacatttcattaaatgagtttcaaggactccataccctgatataggagtacattcaagaaatgagtttaggccgggcgcggtggctcacacctgtaatcccagcactttgggaggccgagacgagtggatcacctgaggtcaggagttccagaccagcctgaccaacatggtgaaaccccatctctactaaaaaaaatacagaaattacccgggcatggtggctggtgcctgtaatccccgctacttgggaggccaaggtgggagaatcgcttgaacctgggaggcggaggttgcagtgagccaagttcgtgccattgcactctggcctgggtaacaagagtgaaactccgtttagaaatgagtttagtctgggagaatctgctttttgagtaaaaaagtttgattttatgtatgtgtgcgtctgtatatatgtttctgtatcctgagtatttctttgcggcttcttcagttatgaaagaggttggtactgttacccttacgttataggtattacaaactcggttttacaaggttacataaactaatggccctggggcgaatgacgtatgccacttttgtgttgatttgtagaacttacttagctttggcatttcccctagtaattcccaaggcaaaaccaggaattgtcagagacgtgaccagacatgtattaaaattctagtgcaattgggaaacttggtcttcctgatttgtttatacttcagccaaacccagatatatagtgctcagcagaaattattcaaaatgttgatactcaagattgaaggatggattagggagaaatgaaaacttttcttcttgtggactttttaggtatgaaatttaatcacgagagtagttttgcttttctttccctgacctttcgcttcattcctttgttaagaactatatagtgcctctgaggaggtggcattattgttcactaacttaccataaatcaggggtctccaaaccccaggccacagactggtacccatctgtggcgtgtgaggaagtgtgctgcacagcaggaggtgagcggcggatgagcaggtgaagcttcacgtgttgttgttgttgtttattgagatggagtctcgctctgttgcccaggctggagtgcagtggcacgatctcggctcactgcaacctccgcctcccgggttcaagcagttatactgtctcagcctcccgagtagctgggactacaggtgcccgccaccacacccggctaattttttatttttagtagagatggggtttcaccatgttggccaggcaggtctcaaactcctgacctcgtgatctgcccgacttggcctcccaaagtactgggattacaggcgtgagccactgcacctggccagcttcgtgtgtatttatagctgctccccatcactcacatcactgcctgagctccacctcctgtcagaacagacccagcattagactcccctaagagcgtgaaccctattgtgaactgcgcacgtgaaggatctaggttttgcgctccttatgagaatctaatgcctgatgatctgagatggaacggtttcatccagaaaccatccccctgcttccctgtctgtagaaaaattgtcttctatgaaatgggtccctggtgccagaaaggttggggactgctgtcataaataacattgaatttcatgtgggttttttttttttgacacaccaggcatgtctcttccattcaaatgctatggctacagagggaaagggtagccagataattatccacatgcttcaaaccaaaaagataaaaaagttggcaactagatctagttgcctgccaggatgaccagcgttatgctggtgtgtgcgtgtccatgcctccgggatttttccagggttatcaatgtcagtgtaagatctgatggaatttaccgttgactcaattttcttcaccaatcaaggctcattccttgaggcatgagttatgcgaaaagcttttctgcaccaagtactttcattctggtctttggaattgtcataattctgacagagaacacagaccattactgaatgctcttcaggttaccctatttgcctgtcacattgcttctaccggccacatcctgcatttcctgtgggacagcattttcaaacggattctagtgtttgagctggaaccaaaagaatgaaactgtttttacataagtgcatattgctgtctctgcaaataaagtacaacaatatgactgacttgtaaatatcttccaggacaatgctgtgattttccagttgattctgcaactttaaagatataaccaagtataattaggccgttcaaggatgaatgggtcccacagaagctagaaatagtttacttcctgcttccatttctagatgcagaagactaatattcacagaaaaattacgtagacaaattttgtttactagatctaaaacattcctgcttctcagaaaaacaaaaccaaaggagtatttaagataaagtaacagtgaacgtgttgagactaaaaagtttccatcaactagtcccatatgcaccctctacccttcacataatctctttggacactcggctccaattttgtcttatttttcttcacatctcaatctacaccttcctaatatgtccggaattggtggattcttggtttcactgacttcaagaatgaagtcgcggaccctcacagtgagtgttacagttcttaaaggcagcgtgtccggagtttgttccttctgatgttcggatgtgtttggagtttcttccttctggtgggttcgtggtgtcgctggctcaggagtgaagctgcagaccttcgcggtgagtgttacagctcttaaggcagcgcgtccagagttgttcattcctcccagtgggctcgtggtctcgctggcttcaggagtaaagctgcagacctttgcggtgagtgttacagctcataaaagcagtgtggacccaaagagtgagcagtagcaagatttattgcaaagagcgaaagaacaaagcttccacagtgtggaaggggacccgagcgggttgccaccgctggctcgggcagcctgcttttattctcttatctggccccacccacatcctgctgattggtagagccgagtggtctgttttgacagggcactgatttgtgtgtttacaatccctgagctagacacaaatgttctccaaggccccaccagagtagctagatacagagggttgattggtgcattcacgaaccttgagctagacacagggtgctgattggtgtgtttacaaaccttgagctagatacagagtgccgattggtgtatttacaatccctgagctagacataaaggttctccaagtccccaccagactcaggagcccagctggcttcacccagtggatcctgcaccagagctgcaggtggagctacctgccagtcccacgccctgtgcccacactcctcagcccttggctggttgatgggactgggcgctgtggagcagggggcggcgctcggggaggctcaggccgcacaggagcccacggagttcggggaggctcaggcatggcgggctgcaggtcctgagccctgccctgtgggaaggcagctaaggccctgtgagaaattgagcacagcagctgctggcccgggtgctaaaagcccctcactgctcgggcggtggggccagctggctgctccgagcgcagggtccgctgagcccacgcccacctggaactcgcactggcctgcaagcaccgtgcgcagccccggttcccgcccatgcctctccctccacacctctccctccacacctcccggcaagctgagggagccggctccgccttggccagccgagaaaggggctcccacagtgcagcggcgggctgaagggctcctcaagtgccgccaaagtggaagcccaggcagaggaggtgctgagagtgagtgaggggtgtgagggctgccagtgcgctgtcacctctcactaatttccccttagtttattttttgtttaaaatggagtttcgctcttgttgcccaggctggagtgcaatggcgaaatcttggctcactgtaacctccacctcctaggttcaagcaattctcgtgcctcagcctcccaagtagctgggatgacaggcacccacacctggctaatttttgtatttttagtagagaagggatttcaccaggtaggcccggttggtctcaaactcctgacctcaggtaatccacctgccttggcctcccaaagtgctgggattacaagcgtgagccaccgcccccagcctcccctcttagtttaattcctggtctaattgtagttgtcacatccaaaccagtcctccaacaatagcctgctgaggctggtcatgaaggggctccgagcactgtcagcaactggcctgaacttcaggctctcccaagatctgcatcttctcattggaagcctctcactgaaacaactgttcctcctgttaccctctatctctggaggctgatttattctaattccctttattcctctatctcacttccacctctttttctgcagggtcctggccaagatagctcttctagtctagctcacccggcccaatctttcttataaattttcttaaatgtaacttcaactcaaccaacttcaaggtcacctgtgattctttctgtagtcaatattccatctgtttgcactgaagctttattccttcaatgcctaatttttatgaaactgatgagactaagtttctagtctcataagtcatcaaatctagtgtcatgagcagagaggttgttgagatgtatgtggcaaggacaaaggacagctcttcaacaattgcccttcctgtttttcctgtaggaatcgtaacatcatttacatgttatatcgaaatgggccatgtgtgtgtagctggccttttttttcctaccatgtacttgtgtgttctggaatcagtcagctagaaaatatttaccaagtgtcttaggctttttcactgtagtgtgcatttaacgtacacagtaaagaatgaaggctggcactaaactgttagctaatcatccggtgttccatgtgaatgacagaacacggaataaacctgatgacaccaccactttattttgagctaaatcctcatttaagtgagaacaggacaggtttcaccactgcctcctttggcaacttgagtggtggtgttcccaccgagtttatggctgcaaagataggtcttttctcgtatttatgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaagggggaccatggccaagagaagccctaaatgacagaagctcattaaaaccaagtcccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaacctgagatacgaggcagcaactagcgacacttacaggaagggaaagaacaatgacaacacccgcccagccccacccccaaaaagctgctgttgtgaattaaggcttcaaaagaggacccacattgtagctgataaaactcaagccaggaggatgtttgaaagccaatctgcactatcacttgttccagtgacctcctatgttcagctgccaggaccgattccatacagtgattgtaggttgaggactgaggacgcccctttgctctcgctccattttgatttgctttttccactgaagacacgccggccagcgtttccaaaaacagcttggccatggctttgcactctattcacaactgatcaaaactcaatggtcttctcagctttctcaaccgttttattctgaatattccttcctcactaaagcctctctcagccctactagtaaatgtgaaagtctgaggcaatcatagaaacatcagccccatcgcatgccgaggggataaaagccactaaggaaacaggtttcctgcttctcctcagcaatttgtacctttcttaatcttcccataatttacctccctaggaagtttcctataaaattctgccatattattacattttaccaactgtatccatgcagtgaagcagaaagggcaaaaacatctgctttggctgagaatttgaaggtgctgctgctctgctaccaacccaaataaattcacatttggcttgaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtactgggtttgctctaaggtagaccttggcaaggcccctaatggtccgtccagcagagtgatgctcgtgtccctcggctgtcaggtgagcgtgggtttgtgaatcagctttggataggatcatttctcttggatttaccactaggctctgtccctaacagggtctacctacctgacccccaagctggctcagtctcagcgctaaggtgtactatggaagggtccggacaaagactaatatttgagatctcttagtagcacaacgtgaaaatggtaggggattttgtcctccaacaccaaagacacttgcttttttaagaacaagaggatgtgtaattcactgaataaaatggttttcctccgtctaggggggattctagcatctgcccttccatttttgttgagagaagtattagctgatctctcaaatgcagatgttaagagagtaacaactgggttgatccacctgttgcttttacaccatagctccattttccaaaaatatatatgtatgtacatatatatatttcagatttacagggaatttttttgtgaacaagaaaaaaaaattgtctatagaagtcacaagtgtctttcttctcaggagacctcaatgatttccatgctgcccgaaaagctagactgactgcccactttccccagctcttcccgtgacctgttctctgacatgatgctctctccaaattccatttggcagcttctgcgtttaaactgcttttcaaaggggctctcttcatgccagctccgccgcgagtcagctctgtcacttggcttctgccgcctgcgcacagaatagacttggtctccgcaagtgggcagctggctgcagctgtaggcagagtaactggcactgcctccgtagatggctgaggcagagtagaagtgtgaggactctgtggcaaaataccagctgctggtcagggaaggggtagaggtctggggggccaagatatccgagtgccagcccttaaggcccaggccagcagacttcgtgaggtgctgctggctggtggaaaggccgaaaaggaagctggtgtggtaattgtcctccacgctcccacttcgatgcagtggagataaaagggacctctgggcggtgccactgctgctggttctgaccgaatgcaatcgcttgctctggctgtctgaaggcctggcggtctgcagcttcttggggatgctggcttcctccttatcaggactggtttcgggagtctgctccgatagttcctgaacaggggagaactggcatagcttgttggtcccatccagagtagtggaaggtttgtagtattccaaagcatcttctgatgaggagaagccatgtaaggatgctgccatgctggctgaatatgaaactgatttgatatccagagagaaggaacgcttgagcttattgctgtcttccagcctgtctgcggacaggtgcagcccactgagcgcctgtaccagcgggctgtcctctaacagcgacggctgcacgctgggcacgctgggcacgctggcgggatgcacgggcctttgtcctgctgcctctgaggtagcagagtcggcacagggtggactgaggggcgtctcgcttttctgtccaccctctgagacagcagggacaggttcatttggcttctccaggtgcagcagcttgagtttgctctttggccctgatgctccagtctggttcttaatcttcttctcatagtccaggagttggcccagaaaattgaagtttggagatatagtaggtcttttttctttcacaaatctgcagagagaggaaaaaacaaaaacccgaattttacaactacactttatcttaagaatattaagtgaataaatgagatagggaattatcaggcagacctcaaaaactttggaagatgattggtttacaagttcggggagatgcttcaaggtggagaatacaaaggccctaggcactggggaagctttgcacacatcctggagtatgccagaagaggcagctgggccccaaaggctctagtttttgtctccttattttcaaaggcccagggctcccaatgcagctgataagagatggtatggggttttgttggtggtggtcttttttttttttaagagacagagacttgttctgtcgcccaggctggaatacagtggcatgatcatagctcactgcagcctcgaattcctgggcacgtgcagtcctcccacctcagcctcctgagtagctgggattacaggactacacgcttggctaattttaatttttaaagtttcttttgtagagaaagggtctcactgtgttgcccaggctggtcttgaacttctgggctcaagtgattctcccaccttggcctcccaaagtgctgggactacaggtgtgagccaccatgcctggccaagagatgattatttattcaccaccaaggacacccctgacacacacacaccagtgctaccatcaaaagtacagtataacagccactctccttcttcaatttccaatgtcatcccctcttaaagtcaccagtcacttctcaagacagttcacattttaaatttaatgacaaaaagaagatggtatcagatgatcaaagtatcaaagcaacacttctttttatagtcaacatgacagactaaccaagacaaagtggtctctgtgtgctaagcactgtgcttatgcactgaatcatcatttcatcctcagaactaccctttatcaggtgggtgtcattatccccatcatatagctccacagaatccttaagtgacttgcccaaaatcacacagctactaaatgatggtgctggattcaaaaccaggctggtcaaatatctgggtccatttttgtaaccactatgttaaaaaaaagattcatcaaaggatcaaaactaatactagatggctttcatgtttcatggaggaaataaagactcagagatgacagaccaattcttcagcggcccctgcacctcatggatacttttcaggtgatggaggagtagaactacactgaaaatttgcatttgaataaggaacaaggaaaaaaaaaacttggaaatcaagtaacctaaagcaaattcacaaaaatagaaataactggctcaagaataacaagtataaatgtagggtgctcataatgagacttcataacgtgatagaagggtgccttttcttctgatttctacatggagcaggaggacctcagggaggtctgaacggcggcatgagagctcgtgcagatgaccagaggacccacgtcctccaggctgctgacttaacatgggaagctgtttgggcagctcatttctgttttccaaactttgcaatttgagaaaaaaaaaatccaactgttaaatcaggcctgctccatgagtctctatatttttgattccttatcagataaaaatgaaccatctctacccaacgatacatgcaggggagtcagacaaatcagagactggaggcaacccagtcaaaatcacacacacacaatctggccgactctagaatgtaggaaattttactgaagaatggagtctgacagttaatctggttcatatttgcatttatgaggctttttcttcccagcaatccaaagtttgaagcagaacagagattctgcagtgagcattctattagagcttccccccatcatatgcaaattaaaacaaaggatacttttgcatttagggaaagcaataaactcatgtaacaggatagagatctctgcctggatctgttgttccttaaacataaaaagtggctgaggatgagtctgacacatgtgaaggcagaattaatgctaaatagtaaaacagcattcttttccaatcttcacaagaccattaaaaaatccacagtaacctgtaaaaaatgtgactaaaataatcatgatctgctttaatttggttacccatcctcatcattctttatgtttcaggtcaaatgaaaagccaatcacagaagacattttcctgccctcacctgtaagcttcatctaaagacatgtccatcctcttcatgatgtaggcgatagcgatggtggcggagcgggagatcccagctaaacagtgcactagaacacatccattggaggcttttgctttctctgtataagtcaaatgcaagaaaggtcactactaactattttgttcagcagtgaaatcttgtttccatttacttactcagtgtcttccacctgaaaacctctacgcaaatctcatctgtgtatatcatatttatcctcgcaatattcttttgaggaggcaggggaagataattccctcaccactgacatgcaggacaactggggtccaaaactgtttgttaataagcaattcgttaataagcaagctactactaactcaggtttcctgacttatgttagtattttcccctaagatatgggtaatatttaatatattcctgttatctgacacttcaaatttttccctgattacctaagaaatataattacattttttaaaatcattattactattttgagatagagtcttgctctgtcgcccaggctggagtgcacgatgtcggctcattgcaatctccgcctcccggattcaagtgattctcctgccttagcctccagagtagctgggattacaggtgtgcagcaccacgcctggctaatttttctatttttagtggagttgcggtttcaccatgttgggcaggctggtctctaactcctggcctcaagtgatccgtccacctcagcctcccaaagtgctgggattacaggagtgagccactgcccctggcctccctattttaagcaacttttctgtatgtcataaaatggctcaactttatttactgagttttagaagaaaaccttgtataggctatgaatcaggtttagcaggtcactttaatgagatccaagagaacttttatcccttccttgataccaggagttattgtcttatggcattatctcaattccccacaacatgatggaaggactcacggacactttgttagaaccaaagaaccaaggaaatccaagcagtgctgccatctctcactgctgaggggcttaacaatatgtacatgtggcaggggacgaggttattccacacagcctggaagctactaacattctggccagttccatgactgcctcaattctaaataattacatgtgtgctcagtcatgaagctgaattctccccttttcattcttggtagatactaccaaaagtctactgaaccttgtgttaaaattcttgcgattaacagatgcgcaaagaatcttactttggcagctgaataatacaaagctattcaatctcactgcctatgctataaatataagtttctagtgtaatgattattatatataacataattattcatcatatataaagcaacatacaggttttgggtagcatatgaataattaagcagcaagcagcttcccttctagatcaggaaaccaaacacaataaaacactaacaaatgaataccaagcaacactcaaacaaagaattgcatgctatacaagtaagaacatataaactcgtgtacacagtctcatgccttcctgtgcctccagcatccccttccttctcagctatcatttaccccacgttactctcagtgtttccttccctttctgccctactgctaagaagctcaaagctaaggtttctactcaatttcaataagaagtagcaattcagactttttgtcagttactgtacatttcctagcccctattacttgattattgctcctttataccattataatgtgtatgtgtgagaatatgtgtatcttttggttctaacctattattgaaaactgcttcaaatccttactggaaggagtctgggtttttgttttttaatgttgacaatactctctcattaattttaataattatctatctcaaaacctagattataaggacctagaaggatcttgcttgcttctaacaatcccccaaaagacttaacgctaggcacatggtaggcatccagctgatactggctgatacatattttcaaaagagattttaataaaaaaagaagaaggctggaaggaaataaaacaatgacagtaacatgcgttacgatgttgaggttataggtttccttttctctgtttttcaaattttctgcaatgtgcttacaactgtttttataaccacaactcttttgatgacgtcttttaaaaatgaaaaaaacaagtgactatactggagttgaggttcaccagcatgcatcttgggagacatgagccctaaactgtgtcttcaagcaaaggaattaatttaacacacacaactggcagagaggagaagggaaatgtgtgcgagaaagccctgcagtgggactgagcaaagtgctcattcgaaaacagcctgccttggagaagaaaccagagagaaggtttgagaaggtttcaaaggtgggaagcaggtgtttgagggtggtgggaatgttaggctaagggctacatttgttttttcagacagggtctcactctgttcatccaggctggagtgccatagtgcaaacatagctcactgtaactgtgagctcctaggctcaagcgatcctcctgcctcagcctcccagctaggactacaggtgcacaccaccatgcctggctaatttttgaaaattttttgtagagacaggatcttgctatgttgactaggctggtgtcaaactcctggcctcaagcaatcctcccgcctccgcttcccaaagtgctgtgattgattacacacgctgcacctggccaaggctacctttttaacgcagaaaactaagaagcctcttcaggtttctgaataaagaacgagaaggcaatgatgatgaaaactggaaacaagcaggtggccattaccgcaattaaggctaaaatctaggttaagaaaggggagagagaactgcaaatgaaaagggcaaagatgcagtgaggatgagaagttacaaaagctaaaaagaaggaagtaatactaagaggtgttacagagtccagctcaaaggacagaaaaaaggaggaacttcagataacaatttttaaaatacttattaacagccaattatgagtcaggtactttacaaggtgttcaatggacattatctattttacttatttttattttatctttttggtttactttttttctttttttttcattttacattatctattttaatcctcacaatatccctgtaaggtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctccctatgttgtgtccatgcagtcacgagtttggcatgaggagagctggaggaagagcccaggagacagtgaagaggaagcaagaggctgtatatgtagccagctgggtttgggggcacctcatgagtatcccatagcacaaacgggcaaactctgttactggcacattaactaaaagacaaaactccacataaacctgagtccttccaaccaacccggagacttacccaaatctaatctaaataacaacaacaaaaaagaaaaaatcactatgagcctgtaagtcattaagggggtacatcttcaaatgacatgctatcactaaccatggcttaaaaccccacagatccctaaaacttaaagtataataataaataaaaataaaaaaatttaaaaattaaaaaaaaattttacatttatctttaagaatttgtgtttgagaataattagctcttgccattctactactctgtatgtatgtgggttatcattcttgtgtctttcttctgcttgagtaaataaaaagcaagaacaacaacaaaaaaccccacagaggagaagacttagcaattgtagtgaatatgggctgaattcaaaaagtggcctggagattttgccttgaattacttgggtgggataaggatgatggctctaatagaaccaagcaaatgaaatactgataagtatttgcagatattacaaataaattataatatgtattttgtgtgtatgtgtttaaccaagttgcaaagtagttaaagttcttttgtatgaatgaaagtggcaggatgaccccaatatcttccatgaaaggaaaaaataagttgggagcaaagttattcatattctctattctcttctcttttctactaaactttgtctcctaaagcccacacattgtcatgacttaagaaaatcatgttctcttctaggtagattttgatatctgatttttagctgaaattagagccaatgtctctggaagtgacgtgcaatgggaacattaaccgtaatttattttttttatttttattttttttgagacaaagtctcactctgttgccaaggctggagtgcaatggcgtggtctcggctcactgcaacctccacatcccaggttcaagagattctcctgcctcagcctcccaagtagctgggattacaggtgcccgccaccatgcccgactaatttttatatttttagtagagacgtgttggccaggctatcgcaaactccagcaacctcaggtgatccccccatctcggcctcccaaagtgctgggattacaggcgtaagccaccatgcccagccaattgttattttttaaagagacaaaaacaatgatttgctgaatgttttttagaagtacaatgggagggtgtgtgttaacttgtgggggtttgtttgtgatttttttttttttttttgagatagagtttcactctgttacccaggctggagtgcagtggcgcgatcttggctcactgcaacctccgcctcctggattcaagcaattctcctgcctcagcttcccaagtagctgggactacaggcatgtgccactacgcccagctaatttttgtatttttagtagaggtggggtttcactatatgttggccaggctggtctcgaactcctgacctcaggtgatctgccagcctcggcctcccaaagtgctgggattacaggcgtgagctacctggccatttgtttgtgattactttaatatgaactaagtcatttatcttcagatgtttcacagaatgaatcctaattgaagatgaaaccctcagcaacctggaaatcttgaaaaaaaggcaagtgttttggaattacttaaagttccaaaagcattaaatagaatattcccctcacaggtgaaaattataatatggggcttaatatacataattccactttttgtttttgagacagggtctggctctactgcccaggctggagttcagtggcacaatctcagctcactgcaacctccgcctcctggctcaagcaatcctcccacctcagcctcccgagtaggcgggaccacaggtgcactggtagagacaaggttttgctatgttgcccaagctggtctcgaactcctgggttcaagtgattgcttgcctcggcttgttaaagtgctgggattaaggcataagcccctgtgcctggccaattccacttttttttttttttttttttttttggagacagagtctcactctgctgcctaggctggagtgcaatggtgcaatcttggctcactgcaagctctgcctcccgggttcatgccattctcctgcctcagcctcccgagcagctgggactacaggttcctgtcacctcgcccagctaattttttgtatttttagtagagatgggttttcactgtgttagccaggatggtctcaatctcctgacctcatgatccacccgcctaggcctcccaaagtgctgggattacaggcgtgacccaccgcgcctggccaattccacttttttgaaagaactagttcttttatttttaattatggtaatggtaaccaattcagagtaattatggattagggtgctccaacttatgtaactgggggaaaaaaaattccttacatggaacatcaagagtcactgtggtatgttgctcaggagctagcagtgtttctcctctgctcagccactgtccactaaagccacattccaaatacacatcaccaagttaccacccagcagatctgatcctgtggcaccaaaatgcctcagcagtaagtacccaggggccagagaagctccagaattgaacaagcccaggaagcacaacaaagtatggcacagatgagatcccgtcaagaccattgccaggaaaataaccaaatgagagtgtgtgtgtgtgtgtgtgtgtgtgtgtgtgtgtgtgaaaattctgttagatcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaaggccagtccttagggacagtgtgacacacacgtcaccttgaccaccagatgagtaagctgcaccacgtgctgttttcagacttttgaaatctctgaaataggctccttttctctaaagaaaaaatggggggctgagggggttcacctacacatgagacgatcacccacaggacctgcaatattatttgagctacttaccaatgaaatctactgatttgtccaaccacggcaaaattttctcacaaaagctgtcattcacaggcacacgcaggaaatgagactcggggataaagtcaggctttggacaggtattgctggcatttaacacataaccaatcccattctgctgcatcagctcctatggagagaaagagtagcagttaaagtgactaataatatagtaaacatgatcattctgaaagagtgaagtttaatgtgatgataaaaatgcccagtttccttgaaatataattcattcagatcagtgaagtccaaaaacctagcaaaatgacatctagagacaagtttaaagaaaaaaaaaaatttaaggacaacaaacgctatttaaaatagtatgcttgaagcccacacatcattcatatagtcaagtctctattatcttcattactagagagagaagtggaacaaagaatacaaaagaaaacaacagtttatatgattttagaatatatggacacacaacattttcttcccacacggaacacgctggttctctaagatacaattctagtcattcttctcactctaaatactctctttgaaggctgcacttacttctgtagtcttaattaccagttctacatgctgatggcgtgtgtgtgtgtgtcctcttaaatttccaacccgtatctccaactacctactgactatcaggatgttccacaggcccttcacattcaaaatgtcagaaactaaacatattctctttttcccttttctgcccccaactcctgcctcctctctgtaatccccaaattggtttagggtaataacatcgacccagccaactaagctcgagaataaaatggggctcctttctcttccccatgaccctcatccaaatggctgccaaatccttttggaataacctcttccattgatcctctctcctctctatacccattcactgctcagtagccaagataaccaaaaaagccaccaggagctcttgaagtttgcagtggttttctctccaaaccatgttctgaacaactagaggaatctttgttatgattaaccccaagctgggtgctttatccacattcttttcatttccttgagtctcatttcctgctcctgtcccatatagcacccccaacgtcaaatgtatacccaccctctgttcacacgattcctgtgcttagaaggccctgtccttcttccagaagacactcttcccacttttcctactttaacctcatctgtgaactctttcccactcatgcataattaaccattcagttctctgtccttccaaagtactttgttcacaccattaattaagcacctaccatagtgtgttaccattaacagataattctcatctcccctgttatgtaatgaagtaatgagtaagatcttggaccgcgtcttgtttttgcaccttcagcccagctatagaattgcactcaaaacaatctgttcaactgacatccatccaccatttagcaggcaagcccacacaaacccgcttcatttagtcatccccctgctgcctctcaggagacgttccaagcctggaataattatcttagtctaagcaatcttggtcatttcttccttctcttggaatactaccttttctacaaatcttttccaactacctgaaagaaaatgggcaattttcttcctatattacccttctgaaacatgccagttccctaatctcttcatttactacatttggcacaataaatatactttattttacataaaaggtgaacagcagccgggcgcagtgactcatgcctgtaatcccagcactttgggatggccgaggcaggaggatcacctgaggtcgggagtttgaaaccagcctgaccaacatggagaaaccccaactctactaaaactacaaaattatccaggtgtggtggcacatgtctgtaatcccagctactcgggaaagttgaggcagaagaatcgcttgaactcaggaggcagaggttgtggtgagctgagatcgcgccattgcactccagcctgggcaacaagagcaaaactccatctcaaacaaacacacaaacaaaaaagtggacagcataaatccagattgtgtatgcaaccatctcttatctctgagatgacaatgtcaataaacagcttttggaactaggtggatttcttagattggccaacacccttcagctatgccagagcccaagtcttctgatggtctcatgcttctgttaggttaacaatcaggctacgtagatcttaatggtatttactacaacctttaaacttttgtacatgtagcaaaggttacatttgtttttctatgtgtgaacccaaggtgagtttatctagtactatctgatcaacaacagggtgcagaaactgattcaggatcactcatgtaagaacagaagtgggtcactggagttaaatcagcctttgaggactttctcaccaatagtcctttccaccaacggtactacatttttctcctttccaccaatggtactacagatatgttaaattaaaagtaaaggaattagtaatatccctatccactcaattcaataatgaagaaattacagaagtttctgagaaatgaggtgactctaatagtgttacacactgtacacaatcaaaagacaacaggaaattctaagagaaaacatgttgcaagtcaataaggactgtcaaaattgattttccatagaaaaaatacgatgtacacttctgacaagtaaacttaatagcctacattttaaagaaatgacaacctatattaagtcaaaaaatatttattgagcacctttgttagagaccttttaattagacaatgacacacggtactgattaagaaaatcatatctaacatttaatgaatgcctacaatgtgccaggtactgtattaagcatttaaatggactgtctcatttaattctcacaaccaccctttgatgtgggttcaattattgacctcctggggtcaagtgatccacctgcctcagactcctgagtagctggaactacaggcatgtgccactgctcccctcaaatttttaaacattttttttgtagagacagggtctcgctgtattgtccaggctgctctcaaacttatggcctcaagcgatcctcctaccttggcctcccaaagtgcttggattataggcatgagctactgtatgcagctagtaaaatattttaaacgcaaaatggactgagaaaaaattaaataatttcaatggctttatttataaaatttttagcttaaaaggtctattgattaaatctactatccagatgctacctgaaaatttttttggaatagtaagatgggacttgataaataaaacaagtacaatttgtaaaaacaaacaaaccaaaaacaaaaaaaaacccttaaatacttaatataatttggctactaaattaaatatcataaataagtgccttcttatctggattggtagtcagtggaaaaagtcagttaagggggaaatcattaaaaatgatatatacatactcgaaacatcattttaacttaaaacaaataaacatgcatgaatacactgatttctgatgcaggaccacagcttcttgttttctaggttagctgactggagttcgtaagcaaatcacacctaagtgcatctaccacttctacttttcattttttaaagaagagcaggaacttgtaaaacactatcagtgccaaagccttctagattaaaactgtcccccaaatactttacagctcccttattcccacctaatttgacaaacatatatatggcaatctgtctttcctgaatctttccaaaacacctgacttaggtcacagaaaagcatccctcttccttcacatttcattggtgtatgtcctattttaattaacatacataattataataacaagtccagtggcctaaagttcgagaacaaacacaactgattcttggtaagtatactattcaaatggtggaggcagacgtgctacagcaaagagcccactcatgcagcaggcattcaccttccaaagatgtggggaaaagatgtcgtgaaatctctggagtcagttaagaaagtttctaaagtttcatgtaactgttgttagtttgctctcttgatttttttaatttttttttttttttacaaacttcaatacaaatggctgggaggggatcttaatttttgttggtgtttttaagacacagggtcccaccatgttgtccaggctaacctcaaactcctggattcgagtgatcctcccgtctcagcctcccgagtagctgggattacaggcgtgtgccaccatacctgactcatcttattgtttgtaatggtgaaactgagatggaactataattatgaagaatgagtctgattcttttgtggaataaggattgcttttatttatagatacgtatcaatgacttcttactaaattataaaaagatatttatataattcattcagtttagtttcagcatgctgtataaaacatacacaactgaatatttactctgccctataattaaacatcataatctttaagcttctagagagcagtcaccatatgctgttaaatatttagctcaactttgtgctaagtctgcaaatacacactttctactgattagataatccttcttcactggccttcaaagatccttccaacaccttggcctcacagttctttgaactcctcatcttggcctctcactctcatgagatctagcctggtctctgtcattaccaattaccacaaaccctccataatcttgatttcatgcacccttccactttccagctcactcaagatctcttatactacactacacccagaatctgtaaacccctgcaggaggacctacagtctgatgatctactaattttctctgtccttcatccccatgatgtctgtctgccttccttgcccaatgtaaattctataatcagttattacaatcactcctttccttttaccccaacttcctctgccctcatcaattgttcgtactcacttggcaagattacaaccctagttaagtctaattctccacctagtcagcactgcccatgccactgaacatggccagagaaaaacactccacaatgctacctgatctaactttcaattcatactcctcagcaatctctgtatttccccagtccattcactttttctctttcccatatgccattctgtttccctttttcttcaaactccctatatgtccccactcatcttcactcacagctgaagaatgaccttgcttcctactacaatggaaaaactgaaacagtcagaggcaaattttgatagacttccatcaccacatttacccatctctcagcaaatgcgcccagatataatgccttcccacctgctgttttgggcgaactgtccatactcgtaaggccaatccctccgcttgctaaataaatccatcccctcttgctcaagaacatagctttgtgattctcctttctcctacatcaattttccactgtacaggatcattcttcctacctgcaatcaaacaaaccattatttctcccaccttaaaaatatctcctctcagcttcgcgtctccctccagccattaccccatatctttgaaattccttgaaagaaccccttctacttgatatctccagctccactcctcctgttatctcctgaacccactccattcaggctttcacccccaacactctaccaaaactgctcaatgatcaccagcgatagtcatgttgctaaatccaatgaccaattctcagtcttcatctttcttgacctaaagtactacttggcacactcgactgctccttcctcctggaaaacacgttgtttatttgcctccctgattacttgatttccttccttcctcaatatttacttctcaatattctttgttgggtcattctcaactccccagactttcagggtgggagtgctcacggctcaatccttttctcatctatattttgcctcttagtaattatctgatcatctcttatgacatcaagtactgtctgtatgttaatgactcccacctttatacctcctccttcagggatccccctgccccattcatacatccatctgtctactcaacatctccacttggaagtataacaggcatttcgaactcagcgtgtccagaactgactcctgcccttcctacagactccatctcagttaatggcaactgcatctccgagtctccttgacacctctctttttcacacacccctaccatccaatcctattggctataccttcaatatagagcccaaatctcaccattactgccaccttgacttcaacacattaccatggagcctcctaaccggccttcctgcttccatccagtaggaaattcaggctattttcaacacagaagctaaagtgatcctaacaatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacgaacccttatccctgaagctgactaaaatcagtatctagtaactggtttattagcatcttctaatgagaaaccttcatatatgttccttgcacattttcattttacaagtcactgtaaaatatcattaacttacattcatttcataatttaaaaaagactgtttttcctgggttgaaaattttagattctcaaattcattaacagaaggttttctgagtaaattaacagaaggtgtgtttacttaatgtttaaggacatgtacatttcatacaagttgcatgggttacaaattaggatataactatttattttgaaaaataatcaccaagggcttactatgcatcaaggtattctggggcataaaaaagcaagtgttctcactgagggatgaatagtctactagcaactgtaagacagttgcacgaataatgatgatacaaagaggtatccgatgaatataatgtagcaggataaacaaaatggcagtggaaaacaggagtaaaaccaaagggaaggattctgagaagactatttataatgggaactaaaattgtcagctgaagctcagatggcggtagaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttgggaaggttacctaacctccggtagctttaatttcctcacctgtaaaataaggctaatgatgtgtattttgtaaagccagtatgaggataataaagtgcctgacacataatatagggtcccctgaaatgttagttctcttattttatcttgttgtaaaaattgcttgtaaattgtatggtatatgaattatatctcagtaaagccattacaaaaaaaaaaaaaaaaaaaagcccatgatgtatatttttcactaatccaaactgtcttttctcctaattggtgttaagtagggaaattacattgaatacagcaggcgaggttcatctgcaaagtgaagacatactccccctaaggatttaaatagtgattctagtttcaacacacagttgagtaaactttcaaaaatgattatctgtaaaccaagacaaatttcattttattattatgatttccattcacaacttttctcccttgaaaactttctctctcctaaccctgaaataagctttctcctgcagtcagactaatttctaaatatgagttctatgatcctttgatgcagactgtgaagtagtacagagagaacagattaatatatggccttaatgaaactgctctgtttggtcaaattctctctgttcagtgaggctgaggacagagatctcattaaataaccacaggcatttcaattctagataaaagaattgtaatttttctttctgaagtcaattccatgactaattttgcatttgcccatccatttgccttcaaaactggcctcaagtcctacttaactccatcaagccttcctcaaacgacaaaacacactgtatctactactcaccctagtaggctgcatagtctaccctaagatgacaatgacaagtgtccctataaaccaggaactgtgcttggcatatgccatttcatttgaatgttacatgaacaccaggaggccggagttattgtggcgtgtaggtaaagagactgagatgcagtaacagctgaagtgatatggctggtaaggtggagaactgggatgcaaaactgtccacccctaaagctggctctcaaccatcatgccgtgctgcttccacactgggagggacactgtagtcaccttgtcatgtcaattgttgtttaatgaataggtcttgtctaaccaacttgaacactgtatggtgttctacatagagtgacatcatagacattgaagaaatattttattgataattttgacacgcttttgtgttcctagatcatatatttccactggaaactctgaaagcattcttagcctatattgtgtttaggctatttgttgcctaactcttctaagaaaacaacagagaatgtagcagtcagtcttcctactgtgtaccaggcagaacaataagaaagcctaggaaaaccaattttgcatgttaagaggctgaaataagaagctatacaaaaaatgttgacagcagattatttaaatggagaaggagcaggcagcagagctcctttagaaaagaagctgcagtggttcacctcagatacagttctgcttaataactactcccaataggtaagtcagtcatatgctgcatatatttaaatgtgaacaaaagtctgcatttgaaattgtaactgataagagagaaaagcaatcaagaacttttgtctttcacagagtaaccagagattctttctcaaatcccactcatttcaaatatgaactaggcatcagcagatgacttttatttagtacaataagctgctcccatttcagctctagtacaaagactagaggatgaaagaacacactctgagaaacaaagtacagttgtgagggaaaaggaaaataaaagtatgtttttggtaccgatgacctcttatggtcttctacaaaagaaccatgtctttaaaacatcagtaaaaattaatacatgctgagacctagactgtccaataaggtagcagccacaagccacacatggctactgagcacctaaaatgtgactactccaaattgagatgtgctgtaagtataaaatacacaccagattttaaagactcagtacaaaaagagactgtaaaatatctcagtaattttgtatactgattgcatgttgaaatactattttagatatactaggttaaatatgttatttttaaacattaaaattagttttgcccatttctttacttttaaaggccactggaaaaatttaaattatgtatgtgacttgcattatatttctgttggacggtactggtatagatgatgttgcagaaaaaacagggaaagaaattctccattgtgactcaatagacttaagatttcagtccttcgtaacagcctgctatagagaattcctttttccagaagatgggcatttttggtgtaatataagcatgggacttaaaattacagcagcctcggtttacatttgatctgtgccactgactagctctgaagtccatgacataatctcgggtaagtgacttagctcagggcaaatgtatctcctaatcctattatgagggttaaatgcaataatataaaaagcccagcattttaaatgggaaacattatgattctcccaagaaaatttctgtgacatgcttctaacatattttggtggcacttcatttaaaaaaaaaaaaaagactaataggccaggcacggtggctcacgcctgtaatcccagcactttgggaggctgaggcgggcggatcacgaggtcaggagatcgagaccatcctggcaaacatggtgaaaccccgtctatattaaaaatacaaaaattagtcaggcatggtggtgcgtgcctgtagtctcagctactcgggaggctgaggcaggagaattgcttgaacacgggagggggaggttgcagtgagccgagatcatgccactgcactccagcctggtgacagggcaagactccatctcaaagaaacaaaacaaaacaaaacaaaacaaaacactaataatattagtggtctcatggttactgtttgtaaagacttcaacttctgaattttaataaaaagaactgtactgttagggaagattataaaattttcatttttggagatctttaggaaaaaaagaagcatattatttctcttggaaagtataaatcacgaagttcagcaggatgataggttagttaatactatttgtaaaaaagaggcaaatctagttctaaaactcaactggataatgttggggaattcatgtaacatttttggaatactgatttcctcacttatcaaatgctggtggctgactaaatgatctctgaaatctccttcaacgctaaggtttttgtcaacaacgaacctagaggtcaaacatgcatttctttattttattttttattatttatttatttatttatttatttattttttgagatagggctttgctctgtcacccaggctagagtacactggcacaatctgggctcagtgcagcctctgcctcccaagctcaagcaatcctcccacctcagcctcccaagtagctggaactacaggctagggccacaaagcccggctaatttttgtaatttttgtagagacggggttttgccacgttgtcctggctgttctcaaactcctgagctcaaatgatctgcccacctgacccttccaaggtgctaggattccaaagtgtgtgagccacaaatataaatttatattcactgctttcaaagctatccagcttaatagtttattcttatttctcaccatccttgcagaataaaaataaaagtctatacatctattttaggggtgcttcctgacaagccttctataataactccttgcccaaggtgttgtcctataaacttccacaaacccattctccccactgcaaatatttcctctcgatacatctacctatgtatcctgcttagtgctgtatatgtttagaagccagagttaaaaaaagaaaactactatttttcccatcctcaactccaaattctggtttaactgctgtcaccttttttaaccaacatatttattaaatctgaaaaaggtatacagcaaaatgaatgtgtcatttaactgagtgtcaaaagtaacaaaaactatctgtaacacaattacttgtggaatgacctgctgatggctggttaaggtttaccaggattaaacaggattcttaactaggaattttattttattttctgatctgaagattaaataaaccagctccagctttgccctaggaatgcatgggactttaagaaattaattttgctttctgtaacatagcctgcttatctctaaaaagaattaataataactgcacactcaaaggcattgtgaccccaccagaaaggctcggtacaagcataagctattaaatctcaaatcggcagatctcacagtaaaagcagacatattaacaacacagtgttgaggcaaaattttgaaaaggcaggagttttaaacatacacacactcacaaaagaatgccttattgctacccaatgacccgatgatcgggtatttttcttcctcctagaaagccttgccttccaggtgctaaagaaagccagtctggaagcttatttttacaatcagcccaattcttctagttactcaaggagaacgtgttaaggggttcttccctttgcataggaaaatagcacttgtaaatcaccaatagttgaattaagatctctgactgctttttcaatttgtggtgatgtaaattaagagattttagagaaaaatcacttttccacgcagtaagagcactattttgcagcattactaattaagagcatacaagctgtggagtcagattatagttctattgctgttctgcttgtaccatcatatacaaaggcctcactcaatccaatgtgttcctccattagggcacgctttgtccagtagggcccgtgtctttttcatcaataatccatgctcttccctcttccttctcaaccaaactcctccaaagagctttaacccagggaggctggcagtgcatagtttcagcctttgtcctcaccatctttttaacacctttccccacccccagccagcagtcatcatgaggaccttcctcaatccaagcccaacctgcatccctttctagtatgttgcaataaataaatatatttctaaatgtgtgataatccaggaactaacagcctgagagtgcccaattataatagatcaattaataccctaagaatataaggctaaacttctgaaaaatcctgtcctatttcagttctcttggacctattaagaacaagtagacatgacaataatttaggtttcctgcagtaaaaagtaacatcaaacaaattaacactccaagagatgacgcaactgttacctggggagcacactgagaatggcatagcagctcctgagattggggtgtgtttcaaatgacataatgggtaactgctgtttctccagctaacaatataaacccagcaatgaaggatattttcaaagcacccaccttgttgaggacatctcgctggcagccaagataaagattgggaagaattcgggttggcccaatgttggcaacaggtaagcaaggctgagaaatgcaggtagggactagagtggattttccttcacagaggccagggaaacaacgagagaactcagcaaacccacctaagaataaacattataaaattataaaaaattatgccacgcacaaaataaaaaccagctttctgtgaactgctcaaacagtttaaacccacgaatccaagtggatatcactgcacacctattcctggctacagctgctgatgctaagactgaagcataatccagcactaggcctggcctataacgctaccatggggataggcaagtcctgaaggcacttataatgaatgactcctctctctcagatattctcttcatcttcacataccctacaacatttgctccccactccccatgcaaatgtttttttttgtaaaacataaagaggatttaaagttagtagcaagtaaccaagccaataattcacagaagcagaatggggatgtaagaaatgaaaactgaggctgaatgcaacttcttcaaaataaaattgatcgagtcaaaaattctttctacaactaactttaaatcttcttaccatacaaattttttactgcaaaggtatcacaaacatactcccacctacgaatattctatcaagttctggggattccctgggcagttagtcaaggtctccataattaccactgatgtctggagagctcccgttcatctcagcaagcactataaagaagtgctgacagactaattgcttagggtgcaggaaggctttgtggcaagattactgaactcagaattagaagaattcagttttttctagtcctgtccttacaatgatctgctctatgaccttcactaagtcacagtcttgccaccactcaatggagtgaaatctatgtagccaaaggaggtgctttcactccctccgggaaaagaaaaaatgagtaaggttatttgctttccaatctaaatattccttgctgtccaaacccaaacaccaaacagattctgataaattttcagatatacgccttgctattcaaaccctcgctattcactaagtccgaatcaaggagatttggatgacgggatcctcgtatatttttaacattaaatttaaaaacaaggcagggctcggtggctcacgcctgtaatccccgcactttgggaggccgaggcaggcggattgcctgaggtcaggggttcgagaccagcctggctaacatggtgaaaccgtctctactaaaaatacaaaaattagccaggcatggtggtgggtgcctgtaatcccagctactcaggaggctgaggcaggagaatcgcttgaacctagaaggcggaggttgcagtgagccgagattgcgccactgcactccagcctgggcaacagagcaacactccgtctcaaaaacaaaaataaaaataaaaaaacaacaaataacatgttaagtcttattagaagatagtacctttttaactgagccttgaacaagatcctgaaatctgactcaagtatttatcttcatctctttgagttatattgtattagactttctcccacttcaagaaacacacaaaatatgcccttgaaaactgctagaagtgcaggaagttgagagggaatcatctttcattatgccctgtattatgtttaattcaagcataattcagccagacgcctgtctctactgtctaggctcagtgcagggtcctcaatgcaacaagttagaatggtaggcagttgacaactatgccacctgcagaatgtaaaaagagtggcctggcctccaacctgaccaagtgtctttctatatattttttaacacagaagcagttaaagctcttccacttactgaagttcttaaggtaatctgataggcagaatacatggatccattatagaaatcacaaattcctttgtgtcacaggccctcaggatacctgcaccttacagtttcatggtttcattttttttttttttttttgagacgaagttttgctcttgttgcccaggctagagtgcgatggcatgatctcagctcactgcaatctccgcctcccgagttcaagagattctcctgcctcagcttcctgagtagctgggactacaggtatgcaccaccaccctcggctaattttgtatttttagtagagacggggtttctccatgttggtcaggctgatctggaactcctgacctcaggtgatccacctgccttggcctccagtttcatttcttaccgtttccaatgatgacctccagccacataaaactcattgttatttcacatttccatgccgttctcttgtccaagaataccaccctcacaccgccccatgcatgcacacgtagaagccacggtacatacagcatacacatgtgggcaagccccatgatcatacagcagaggaagtaagaacacaagcccttgtacctgagttcctgtcctggctttaccactttctagttgtctgatttgtcaagttacttaagcccctcctactctaatttcctcatctataaaatgaggataatgatcacacctatctcacagagttgttgagataattagttagtatatcaaaagtattttgtgcctggcgtatagtaaagcactcaggaggtatcactggttattgctttttttttttttttttttgagacagagtctcactctgtcgcccaggctagagtgcagtggcgcgatcttggctcactgcaacctccgcttcccgggttcaagcgattctcctgcctcagcctcccgagtagctgggactacaggcgcatgccaccacatttggctaattttttatttttagtagagacagggtttcatcaagttggccaggctggtcatgaactcctgacctcaggtgatctgcccacctcggcctccccgtttttttgttacggtgatcaaacattcagtatctagcgccatctgtggggccttcctccacctttgagctgcggctgtttagctacacctccttagtattcatctgagacaaaaagtggaaaaaggaatgcctgtaaggttaacttcccaaagtgtgccccagagcactggcgtcctgcaagaagctgacagacaggatagcggtctaaaaagtgagagaaatattgtatatcctagctccctggcagagtcagagcacatgttaacttactaaaggttctaaaaagtattttcaaagaaactggtttcatttattgaagtctagtaagtttccccaaacttatctgaccatggaattccccctaaaatatattaatagctagtagaattcacacttacaaaatgctacgctagggtcaaagcaactactgaaatggagtcaatcagaactcctgtacttacaagtacaacccacagacaatctcaaaaaaagggggtcagccaatattggtatataagtgcccactgtttagaatttatgcttttgtttctattcgtgttttgttccttttcagtctctctaattgaataacacagtcattatttaagtgagttttttccccaaggtagttcttgtaacaataaatgttaaagattctcatcattctttgcttttcttacacctacccaacctaacaactgtcaggcactattttaattacaattaaattgtatgatgttaaattttaatgtggtgtctattaacatgtagttttggtgtttctcttttttttcttaaagacagggtctcactctgttgcctaggctggagtggcatgatctcagctcactgcaacctctgcctcccaggctcaagtgatcctcccacctcagcttcccgagtagccagggctacaggggaacaccaccacgcccagctaatttttgtatttttgtagagacagggtccttcctatgttgcccaggctggtctcaaactcctaggcacaagtgatctacccaccttggcctcccacagtgctgggtttacaggcatgagccactgcgccctgccagttctggtgtttctctaaagaactgtcttcatatatttttcaattctggctctaaaacagttcctggaatggttgtcatttaaattcaacaaaacagcttgggcaacatggataaacccaatctctgttaaaaaaaaaaaaaaaaaaaaagaaagaaagaaaaaattagccaggcatggtggagtattcctgtagttccagctacttgagaggctgaggtgggaggactgtttgagcccaggaggttgatgatgcagtgagctgtgatcgcaccactgcactccagcctgggtgacaaagtgagaccctgtctcaaaaaaatacatacatacatccaacaaaacaatattccaataaatgttctcaaagagaaaacagagaatccaaggaaacaccacttgaatttcatttgaaccttataaatgattatttttataaataatgtatgtaatcctagaatgtactgaacacttactgcgtgacaaacattgctctaagcactctataggtatttacacactcttacagctgccctatgagataggtgttactactaatcccatttatagataaggctcagaatcacataatataggctcagaatcacgtaatataataaccggaagagccaggttataagtctacttttctaaatcctatggaattactttcaactctcccttggatgcagggacagccttgctgatgatattcatggggtcctggcctccccagctgtgaccaggctaaaaaggccatggtcctctcccaaactgatggaagagccttgtttccccaaagctatatcgctcaaaggcttcaatgagggagaaggaagaagatccgacaagaacagagaaaggagaatctctttaaaggcaatttcacatgacaccaataacaaagtttacagatgaactggttgaaatgtaaatatggtcactggtttgttcatgaccaccatttacaagttggtagtagaccttggctgtcaggtcaccccccacagaacaactttcagaggagatgcaattctgcaataatcataaactgagccatcagccaggctgttcgaggtccagttctatcgttaattggtacagtgatcctagatcactttgatttcagtggacctcaaaagtaagtgtggctctagaaagttctaagacagagaacagaaaggagagaaagaaaccattgttcagcttcaaaacaaaagagccaaacaaaacaacactacactgtaaaacacattataaaacaaaaagaagcctctttttcacaaatctttctcaactgatatctagaacaaactcaaacaaatatttaaaaatatttaacagatttagctgcaatcagaacattcatttagtgctcagtttggcttgaaatgtcccagactggctcccagtcacttccagaaaaccctacctcagccagagcacattttcactgatctttatctatgacaatgttccactctgctgacatcctccttcattgacagttttttccattcactgacctttcattcactgctgcactctagtgactccagtttcgtttcattaattaacaacagatgagacactgcctgatttcccttggacctctaaaaactaactgtggcctcaccagcaactcagttttgaaacatgcttaaaatgtccctcttcctttcgtaagttctcttacaaacaagatccacttcagaagaaaagttcatttatgcaaacgttctgctccaaatggctaacggagacaaagaatcaagcgtcctcttatctgcccttatcataactttgttgtcccagggactccaagctagattccattacaagacataacatcagtccgttatccgctatttactgtgaaaagcagtaccgaaaaactgataagcttcttgaaaaaatttgcgcctattttttaaagttgtctgaagacttggctcactgtccaatcttgccaagtttctcctattcctaattttatgctgtttatcatctgggaatgcagaaaacaaagtcatagtaacccacatgtgtttccctaacatggacctgaacctaagaatgactgtgccccctactctggaagtatctgtgctaagaggaaggaagacaaatacacagctatttccagcctgctgagaaacagggatgggcagtccctgcaggcagagaagcgtcttggcctctacagctgtggatgcacaggcagccagaccgcaatgctaaaacccatgtttctgttagtcttccataaatccaaccaaaagaatgcatgtttacaaataaaaacatagatactacttccgacacagaaaacatctggtacagcttctaaggcattcctcatttagataacaccttctcctaattcagccatgaaaacgtcttcccttaagatcacctccttcacaattccaattataaatatgattttctgtaaaagcaaacgtgaaccaccattccattttgggggggaaaaatctgccaagtaaaataaaatacatataacaactctactaaacaattccaattagtcactcttttctcttccctctcacccatgcaatcagttatatatcacagtattttctttaaatgaaagtatatttacataataaacaaaagtagcactttactgtggcttactgatattcttaaaatgtttttaaggccaaagttctaaaaatagatccctctccttttagcagttccatgactttaaagatggtttcctgcagggagagacagagggcctttccactcatgccttcatttaaatagggagcaagtcactagggatttatcaactggcagagccgccttcaaggaaggcagaatcaaagagaactgccctcccaccctatattgtgaatggattccatggttatacaaagaaataatattgatataaagctctactttatggaagacattttcctaaaaagtcatatgcaaatttaacttttgtattttaaatcatctgcatatagttcatatggtttcacagtttttgaactatgcggttaaattcttgttgttgttgttttttggagatggagtttcactcttgttgcccaggctggagtgcaatggtgcgatctccgctcaccgcaacctccacctcccgggttcaagcaattctcctgcctcagcctcccgagtagctgggatcacaggcatgcgccatcatgcccggctaattttgtattgttagtaaacacggggtttctccatgttggtcaggctggtctcgaactcccaacctcaggtgatcagcccgccttggcctcccaaagcgctgggattacaggcgtgagccaccgtgcccagccattaaattcttttgtagttctcaagtagtttaattcttttgtaaaacaaaactccctttttgtaacataaacacaatcctttcatttgcttattttagaatatatgtgaaaaactagagtacaccttcacctgtagaggacagttctctcttctctccatactggaaagaaaatctgttgctttaccatcacacaaaggagacaactctaacattaaaaatggaaaatactgaaaatgtttattttgcagtaaagtactttaattgctcttaagagtaattctgttatgcctcagtctgacatgtctgatttaggcaactttattctctagacactcaaaaacagactaaagtatggtcacaattctttcgggatcagcagacagtaaacatggagagttgaaactagttgaagaaaagaaaagaaaaaaaaaagcaacataatttcatacccctaaagaaagcaaacaaaatatgtaactaatgtttcaatgtagatactttggtctggataagccaagccacacaggtttggtaaattactcctaggaaggtagagagcatagcattttttccacagcattagcagcattccaccttttcccatatagccaactctccaattgagccatactaaagagaaaaatcccaaatgatctaaagcattaatttaaagctcttattccatccacccccatctactggagcacagaccaagaggagagtggatagatacgcatttctctttcaggaaggctgacaagtagcctacatctcacaaaacttatcccataaatgacacctccaaaagagcttgccctatattaaacaaccctatcacgtgacacagttgggaaatgggaaattctatctaattttggtattaggacatatgcaacagttatgacatacacaacagttatgacatacacaacaaatgaatgaaaaattttcaaagcaccagcagacaaatcactaaacactaaaattatgcaacttataatttcttatgactcagaatgtccagatcttataactcaggataatatttaaatcaactccatcagcaacatccagatgtgttattcaagaaggaagagttctcagaagatgtagactggtaactattctgctgatcttttaaattggcaatacataactatgcccagaaaaactcctcttaaacgtcctgaaacaaagattgttctaaagactgcaaccagaataacccatcaaaaggaatacagccagaatctaccacttggctgaacagaattaacaagctctgtaggtaggagagccagagtcacagagtctccctactattttcctaacacatctgtgctttcccgcctttaggcttttgaaaagtcaacctttccaatccattttgtatttccttctaaaccacaggcaagcacaagttacacctcttctatagcagtatggtcccaaaatttttttaccaggatcaacaaaatacattttacactcaaaccctctgaacacctacacatactcaccactaagacaaaagtttcatgatactatcttccctaattctgttgcgtttaaagaaaaaaaaaaaacaaacttccttgagcagcgtatctagacatggtccagcttagaggctctataaaatttataccaatcatttggcagtacctaccactgacctagtaactgtgaaataactgtgtatgtgttgtgacccgtcttacttctccagctattgtgagctgcttatggataagaattatccataattctttgtaattacctcagcatttagcatagtgcctggcacataattagaattcaataaatgtttattgaatccttccttgttacaatgaatagctgttgatggacataagtcttgtatatttttggtgttccgaaggatttcctgattccattcaaagccaaaagctagttggtgtgggtgggggcacaaaatctgcttcctattcctagaccacaatgccccagaagactctcagggtgagtgaggaggcacagggcaagaaaaaaacattttttcttctactacaggaaaaaagataaaattggcgagtgtcactttggttatccaaaagcgacactgaatccttactatgattctgctgtatccacaggactttacataaaagggaaagaaaattttttctgatgcccctaaatggcgcaggactccacaccggtgtggagagtcccgtaatatatctccatggctcagggaatcagggcacatcccataggaaaccaatgagacaccaactatgattataccccagatgaggatggtgtggctgctggacatgtctataatcatcatcaaaatggataatgaaatgagattatccataggggaaacttgatgagtcaagaggaaaaaggaatacaagtctagtgtctggagaattattcaagaataaaatctgactaacttgtaaactgtccatgaatcacactatacagctcacttctcaggctatccatgtgaagcgcaaagctttctaagccatctagccacaggctctcccctaagaccacttctgtatattccactctgtgtacagtcctcctctttggccaactacacattttgacaagagacgtcatagagcagtgagggagaaagggataactgcgtttcacatataagttcaaaaaacacttaatagcacctactatgagtttgacatagcgctaggtaatggaacagtggtgaccaagacagagagccttctctggagttgacagttttatgggataaactttaaccaaataattagatgaataattaactaattatggtaagtggccaaaggcatatggaaaccaactttgcctggtagctagggaaggcttgacaaccacattgaatctagcaggaaaacaactaggtaaatagcagagagaagagcccagggcagaggacagagcctctgtgaaggcccagggtgcatgatgtcttaggtttagagcaacagggaggaggcctaaggagctgaggcaaaacaacaactgaggacttaaagtggcactggatgaagttagcaaggtaggcagaagccagccactgcagggccttgtgaatcagttaaaaattttgtaacttatcttaagagcactgcatattattgatgcatattaaactgggaagtgatgtaatctgaattagttaaaaacacaaaataaaaatgtaactttggctgcagtgtgagcaatggattggaaggtggcaagacagagcatgtgaacagatcagttaagaggctcctggagcaacctgggggaggaataacattcaactgacttcatggtagcagaagaccagaaaaccagacagaccgaagaggttggaagaaagatctggtgactaagagatgacaggtattgcagccatatctccaatagctcacaatacccatcaccttaaagtacaaattcttccttctgatttaaagagcttacataatttgatctcatgtcctctcaattcccatttctctccttcacaaaaaatccactctggtctgctcactgcccctccaaatctatgttcattcctgacatttttaatcatgttctttccccctcagaatgcgcagaaccctccctacccaaatcttactcctcatctttcaaggtttgattaaaattccactgccctaatcaagtcttccctgacttctgcagactactctgaatcatcccttatcactgtatcatacattttagcaaatgatcatatacttctctttctttcatccactttaggtgcatttccccaaattaaccactacattctcaaaggcaggggcaagccttttgcttttccaatatcttcacccccgagagcccagtccaaggcacagccatggaggcacccatcaaatattgagaggctgagtgagtgaaagggctgaagaatatgctggacctggtgtttctctagactacacagctgccccacctggggcaagggaagattgatgtcactgttgtcatctgggatgcttttgtttggtttgtgcacaatatcaggatggggaaccaaaggactatctttaagctttagttggctctctagtctgtttgtttcaaaagacaatctcaagcatgtgtcttagccactggtagctgggaagagacatgactgactctccacactggcagatagcaatcggagaaaagatgatccaatttagacgaattcatgccaactgagactcagaaacagagccagaaatacacagcagccagtgagcaaacagcacctttttccccagctttattgaagtatgattaacaaacaaaaattttatctgtttaaggtgtacagcatgatgatgtgatatacatatacacttggaatgactaccttacctcacatagccatgctctttttgttgtggtgagaacacttaagatctactctttcagcaaatttgaagtatatggtacgtttattgtcaaccgtagtcaccatgctgtacaataggtctctagaacttactcatcatatcactgaaagtctgtactctttaagcagcatctccccattaccccagccctccagcccctggtaaccaccgttctactgttttcatgagtttgactcttttagatccacatgtgataccatgcagtatttgtctttctgtgtctggcttatttcaattagcataatgtcctccaggttcacccatattgttgcaaaatggtaggatttccttcttttttaaggctgaatattccattgtgtgtgtatgtgtgcatacagcatctatttttagtctgttttcagtgactctcagtcactgtagttttttagacccaagagcagccagttccttaataattggcatacttttactgaaatccattaatttcaatctcatttaccaagttctacaggattcgaaatggaattactgaagatttcccttctccagacaaaggagaagaaacaccaaactagataacagaatttatggtaatagcacaaagagcaaaatccataaccaggaagatcaggttctatcatacctccatgaggaaggacagtaatcaattctattaaaccaaaagtatacatttattacacagaactgtcatcagaatctagatccttattaaattgaaaatgtgtagagtctaatacatttttgttcactcgtaggtctaactacaatagttaagttcaactcaaaacgaagaaatgagtatttggcctttaaccatagcaaacattaatcgaagacctttgctgtgttcttaataaatggtatcttctatccttattcacagctatacaccagcataaaacagagtagacttttacttgatgatctcttctggctaacatagtttaatgctttaaaacaatttatatacagtgtatttttatagattgctatattctataaagtatgaagaatatgactgaaattctcaaaaagactgagaaagagctattacaaaaagagcctttcagaataagcctgatctgaaatgggcacccttgattcccaatctagcctcctgacaaaattccagaagactctggaattacttgtggatgtgggccttgggcagcaagagcttgggagagtcactcagcagctctgttattttcctcatttgtaaatgaaagggctgaagtctgtggttcatttatggttttctcccgcaatcgctgtagggttattctgtgctgcatcacaggacagaagggagtgctgtggaattaataagcctggcagagcccttttgcttttactcaggctgtactggggaaagagaaggacatagtagaacagcatttttcacatgcaggttgatctttatttctactaaattaacccatttactctcttttccatatgtcagcataaaataaaagcccaaattcaatagttttcctttttttcacatatatttacttctaatctggcgctcttagaaatagacaagtagaataaactgatacatagtgaataagtaaaagccaagaaacaagtttatttttcagagaactagttttctgcaggttgttgaaaacaccaaaaaagttgctcaataaatcaatgttggcaactgattttttgggttttcaaactcatactgataagtttcttatttttttttgaaggatagtcttttagactattgatacagaaatttcacatccattgtctaatacaatcctcataataaggcaagcgttattatctctttttaggagctgaaaaaatacaagataattcaggttaaatgacttatccaaagttgccataaggagcagagacacacacagaaaacacaggctacagctttgacccctagtccattgttctttccagcttaaagggatttcctcaatgcagatgttagatcacctagggaatgggtgtgggcatggcactgagttgatcagaagaccctgaaaccttctgcagatgcagatacagagcctgtgctcaggtaatacctttaccactaggacctagtttttcttcctcctgctcttttctgatcctttttctttagtcaatatctaaagtttagcagtaacacgaaagatattaccaacccttgaaaatggttccttttttggattctccaatccccatctctccccttcccctcaatcttaaatcttacatctgcaggagaaaaaacaagaacaggcccggcacatggcatagagcatggcactacctctctctagctctaccttgtgtaatttcttttttcttcttttggagacagggtcttgctctgtcgcccaggctggagttcagtggcacaatcacggctcgctgcaacctcaaaactcctgggatcaagtgagccttccaagtagctgggactataggtatgataccaccgcacccggctaattttttaaatttctagtacagacgaggtctctctctgttggccaggcaggtctcaaactcctgagctcaagtgatcctcctgcctcagcctcctgaagtgttgggaatacaggcataagccaccatgcctggcaccttgtacaatttctatacccagattacctattgctcccaggaagttggtcttctctacgtttatgacttctcattacaagttcaaaatatagtttatcagacacaaaggactttattaaaaagaaaaaatatatagtttattctgccaatattttcctataattctaattatttaatatacttaattatataagctttcctgaaatattctcaatagaattagattcttttcaaattatgagaaacccagttaatttttttagccaaataggaattacagcatttttcccttccaaaagcccatcctagattataaaatcattattatgatacatttatgttacacccatttttttactctattaatatgcttttttttttttttgagatggagtttcattcttgttgcccaggctgaagtgcaatggtgcgatcttggctcaccgcaacctctacctcctggattcaagcaattctcctgcctcagcttcctgagcagctaggattacaggcatgcgccaccacacctggttaattttgtattttttagtagagacggggtttctccacattggtcaggctggttacgaactcccaacctcaggtgatccgcccgcctcggcctcccaaagtgctgggattacaggtgtgagccaccgcacctggccaatatgaattcttaagtctaaatttcaaggggggttgtggggaagatatgcaggtctttaaattgtacttattcaataacctgacttcaaaattgaaaaaaaaaggaaacaatggtttgccattacctacccattaatggtaatagagaactttttttttctttttgagacagagtctcactctgttgcctacaccagggtgcagtgatgcgatcttggctcactgcaacctctgcctcccgggttcaagcaattctcctgcctcagcctcctgagtagctgagactacaggcagatgccaccatgcccggctaatttttatatttttagtagagatggggttttgccatgttggccaggctggtctcgaactcctgacctcaggtgatccacccacctcggcctcccaaagttctgggattacaggtgtaagtcaccatggccgggcagtaatggagaactttctaaagcatccaaatttgttttttttttaagatgagattgctactgataattttgtgttttgtttttttagagacaggctctctgtcacccagactgtagtgcagtgttgcaatcacagctcactgtaacctcgaactcctgggctcaagcaatcctcccccatcagcttcccgagtagctggaaatagaggggtgcaccaccacacccagctgctactgatattaaaccctttaatccactgggagtgaaacaatgctatggcttagtttgacttggttagtaggttatttactaatgactagagcaatcaatttacatttacatttttaaaaatacaataattattctgactgttctcaattaacatgaattcaaggacttgcgtattcctatgagtggagctagatttctagggttgttagctctttatcaaatatcagtatttaaggaccacagaaaattagcactgtttcactacagcagcattttcatcagattttaataccatcttcacatctgcttatatggatgaagaaagtttcatattagatattttcccatcgcagctatatatttgctttatcagaataaatacaccttccaaatcacctattttgaaacaatctgaagttttctctactttcagacttcatcactgcttaatatgcttatattctagactgataaatcataggaaatataaacaatataaaaccttcaggtaagctaatatcaaaatatttactgaaaacttaagaagggctaggccttgcgggaacacaaaggtaaacaagacctggtccatattaaaaaactaagcccactgcattcctgtagaggttccccaaatcccacttccttctccttcagtaatccttcatttttcatgaccatgtaagtaggtcctccaggtaagtgtcagtctcctcttgtttgaaggaaaagagctcgttaagatactgctatcaatttcttgggagtcctcttgttctccttattcacagtcattcttccgtgggtaaggtagccctgagagtgtgagtagatgtggggccacaattcctcactgccatagctaatgaccataaaaaccatctcacatatctgatgctttcttttctcaaggtggctgaaagttctaaaccgatggaaaaattattccaagaaaccactttgtctttctattaccatgtccaaacgagactgacaacaatctccaactgttgaaagtcacaggggcagtttgtagtgaaaattgtctccagtgaccttgtaacttacagtagcccctgtgagaaactagggtgcttttcagttatttctccccaaccaaaatatttaagaaacttttgtcaatatgtccttctgtcccacatccctggcttgtcctctgagcagctggacctttgcaataaaacagtttcccaagaattgatggccaaaccttctccaatactgttatccacttaccccaattatctacctaccctgacgaaaaaattcactaaccaagagaatccccaattgcttttggatgattgggaaggcttctaatcatctagaaccctctcttaggtgtcacaagaaatccagctgctcagaaattcccaaacaagcaattcagactctgaagtcacctcctaagctaatagaaacacaggattctggaggtatggatgaagatatggtgctactaatacatttaatgtggctcctggtgctgcctccatggacttgccgttaggcctaagaaacacttcctgtttgaaacagggatgtcagggtgttctgactcagtgtgtcacaccacgtgtccctagagttgacatagctaatcaggcagtcctgtttcttccttattgcccagtgaatgcccctcccaaggctacacaggatagattaagaaccttcccaggtaacaaaggaatgctctttggtaaaggagtaaagggtacaagtagctaaagcacctgtgctagaaactcaatgtgagctcactcctctggggggctgtctacttgaccgagatgttgagtaaggtctccccatagggtaaaagtaactcaaacaagaacatggtgggataaccactctgtcacgaagcacatcttggcatattgcttctttaagaaagactctggctgggtgtggtggctcatgcctgtaatcccagcactttgggaggccgaggcaggcagatcacctgaggtcaaagttcgagaccagactggccaacatggtgaaacccggtctctactaaaatacaaaaattagccaggcgtggtggcaggtgctcagaatcccagctacttgggaggctgaggcaggagaatcgcttgaacctgggaagcagaggttgcagcaagccaaggtcacaccaccgcactctagcctgggcgacagggcaaaattctgtctcaaaaaaaaaaaaagaaaagaaaaaccctgatcccattaacaggattccaaggtaaagtccctcacacagtggccacctgaaacatgaaatgagttcctaaactcacccaattagtttagtgaaatgctaataatagctgttacatttaacacactcatactcccagtaaaagaatgtgtctatcaacagagacagaatctaatattataattctcagttacagacttctgaaaactacattctaagacaagctggcttcacttaagaacactaattgaaagatcagacggaatcacagcataaatgaaaggtgtacagatagacaatctgaaaaagatgaactatccttgttcttagagaactgaggaaaagcttgtgagagagaactggagacatggaaatcttatctaaacctgcccagagtttaaaattattaacacaccaacaactaattaatcttaatgttttgtttttcttagaccaaatgtttaaaagcactcttgcctatcactgaagctgaatccgcccaacacagcagctttatgttaaggttactgtgtgttgtcaaactatattcccagctctatgagcccacagggcaagggaaaggattttcatttgcaaaacgagaagcaaaggatgaatagccttctttggaatttgatgggattaactcctacaatgccgtcctccaggagagatatagaatatttggtccttcccacacactttataagatcatctggttgcttagcatttctacgttgagacttttttttaattataaaacaaataaaaatatacaagtaacttttaaaacaattcccctaattaccagaagaaacattctgcacacattctccccctatttcattgtttataatgcccagaaaggtgaccataaggcttatctctggagtccgctccaactataaatgttaagtaagagtttgacactgtaatattggtctggttcttgccacaggggtgggaactagcaggagctgagatgttcatcatttggtgttcttacatcacaggtgaatggaaaaaggcagacagaagcagctggctttgagctatccatatgggtgtgcaaatctatgtggcactaccagttaatagcaagcaaagaggcacttgagccaagtcaaaaatacactgacctatgtggaagaatgatatagtattcaagttaaatagaacggtgacatcaatcaaaagctataaataaatcattttacacagcaaagttgggatgatctattgtactgagttcacagtgaaatatgcttactcatacagctcagcaagattctgagtccttttaattccatcacgagccttacctgcaagcaggtgaacagagttgaagctcttctccagtttacccagaagtacagtgagaaaacagtctgaagagagagaggcaacatcttgggagctttgatcgtaaactacaaccttctgactgcaatcaatgtcaacctgaaatgcaaacatgaggcttgttaggaagaaggtgagaaaagtaatctcaaactactgcttaagatctcacatttaccagtgctggggcgaataattgcttcctgttttcaattaataatttgaataaaaatgagatgtagtcaatttacgagacagacacatacaaaactcttaaaaaccaaaatgatgctatttctgtgtaggtgatctcacgattccctggttttaaatcctttatactataaaatggtaaagttcataataaaccaaacaatatgcaaaataaacataaccctggacctaaacaaactttttttaaaatgacttttacaccttaacaaagaaatcagttgtttatttaaattaaaacatgagctcatttgtatttgtgaagaaaaaaaccaacttcctcaccacacagacaacattttagtatcccaggaataacttcccttgaagatatcattaagtcttgaccaatgttaccacatgtgttatgacacataaaaagcacccctaataattagttcctactttctttccaaagaacttgaaaagaatgactttcctttcagtaaatttgcagataatatagaatagtgtttaataaaatcattttagcaagccacaagaaaatatagcacttgtccaaactaaagcaagttaatccttcatagtttagaaatattattaaatgtggcaatatggacaataaattattttgaggtaccacaaggcaccaaaatttaaaaagcaaccaaaacttcctcaaattactttctctacttaaagaggaggcttcaattaaaattattcctcattcagtgtgtccatttattttgaaaaggcaaaaaggaaagcgtttaccttatgtttcgctgaatgctggatgagctctgtaattaacactttgtcctgttgcaaccttcgcttcataagcttggagcagttgatattaatggcttccaaaatgtgggatgtattgtattccacaaatggccggctatcaattagcagcactttttccgttccactttccagcagagccaccaacctctcagtaacaatttgagttccaatcatctcatgggccatgacaacaataagtcctcttttcccacctccttctttaatttgccacgatgatgtaatggtggtgtgctcaaaggctcagccactccattgtactaaaagtgtatgaggtcaggctggtggtgactggcaaaaggagagttaaacccattttcagcaagagccctccaagtgaatgtctctttctctttcccgttgatgtgctcttgcaaaggactccgtccacaaagcagcccctcacatttgattcataaagagatgactggaataaccattccacaacaaaagatgctttggagcagccagcgcattacatcattctttacctttgctcccgcgctccaacagctttacactggactgaaagcctacgcggagagagaaagacagaaaacaaaacgtgaggtcaaaaaaagaagaaagagtgtcagattagagagagtgtatgattcataatatttactccattaatctaattccatacttgatgcactgcttcatttgaacaaacaaataaaaaggacaaattggtatggcttcagaaaaatgtgctagtgataattccattttacctcaaaatgtaaaaactcaaagaaaacaaaacaagacatatcatgaattataatcacctagggctcagaactaaatgacctgtagtattgaattaaaagggctacaaaaagctgcttgaagtattattattccaaatagttttcctatattttatttgcttatttattgaaatcccacaaagaatggcagctgaggacaaagttagcaatcctgtgttaccaggacaaaaaaaaaaatattttctgaaatggcttgagaattcctgcgatgaatgggtaggtgtatatgtgtgtatgtgtgtgcacatgtgagctcacgcgagtaccagggcgcaaacagcagccttttaaaattgccctcacggaggagagaagatgcaggaaaactggagtttctataaatttcagctatcttttaaggaagaggaaggacaaaaacaactgatatgtttgtcacagcagctgctgagctaggcctgtgaagtgctgaagctcacagccatggccctgtcatgtctccttccggaggccatctccctaccaccaagttgcttaaggccctgtaagcttatccttcactttttcctgcttcattcttcagagaatcactaactcctagtcttaaaaaaatctcaccccttaacctggaactctaagttggcaacccagacatagagagcccttaaagctgaacccagtgcttccctttcttgccaaactcctttaatcaatcactttctaattaacactagttgaagttttgcgcttattgcttggacttcaccttgaccttcaatactctcggattcctatctcccctggtccatctctgcttatatgaaatcctctactacataaaactacatgtctacttctggcactgaacttctagagggtaaattttttttttttttgagacagggtcttgctctgtcacccaggctgcagtgcagtagcacaatctcagctcactgcaacccctgcctctcaggctcaagtgattctcctgcctcagcctcccaagttgctgggactacaggcgcgcaccaccacacccagctaatttttgtactttttgtagagacagggtttcgccatgttgcccaggctggtctcaaactcctgggctcaagcaatccacctgtctcagcctcccaaagtgctgggactacaggtatgagccaccgcacccagcctagagggtaaatatttgattgcaaaagtttattatatttcttacttctacagtactttggacataacatactcaatatattattatagtaggtaaattcttccttgttccaaaaacagtttaagattctaaataaatatttgattagctgatttcaggtcaggatgtcagagcctttaaaaacctttagatcatgtttcctaattttgtacttacaaattagaagctaaagcatggagacagaaggtggagcatgatataaagagatgtagctttgccatttacttatgcaaccttggacaaatcacataacctctctaaaccacagtttcttcacctacaaaatggagacattatagtggcctcatctcttcaaatttggtctgagaacaaaattatctaatttattgaaagctggtaaataaaaaagcaactatgcatcatagacaggaggaaaaataccctacagatgccaatggcaaacaaagctggcttgcatctggcatctgaaagacatcactcacagataaaaacagatgtaattccatcctcctatagtacagctgcaaccaaactgtgccctttctcacagaggctgacacacagggagttagaaggcacctgagatactgtctcaaccacaccatattttacaaaccagctccatttaatacattatatttccatttcttattttccaagaaacaactttcattaatgtattatttttagcatagctttatggtaatgaagtacaaaagtcatctctattttcaactgaaggaactataagagagaatttgtcctagtcaatccactaataaacttctgcaaagcgcctaccaaagccataccactcaatcaggttctgcctgctcagtgacagagttcacggcaatgtaaggtcctgtattcagattgtctgattcccaaaccagggcttctactactgggttgccctgttttccctaagtacttgttcccataatggaactggactgggaaagaatgatgccaattgtccatgagggtacccaggtggcacagaaagtggaaatccgagaacaagagcaagttgattccaacaatggcactgggtctctgagtctgattggctcctctcaaagagataaaatccggatgggacaaagcagttatctgggttagcagatcaagggacaaaaggagggagaagtcagcaaacatgcaaaagttgaattagaaagttctcatctttgcttcccctcagccaattctcataaacccaaagacaggttacaacaaacagttctacagagcagagaatgtcattcttgcccagagaatcagagcttagttacagatataaaaagaccctttccctgaccaagaaaggctctggtcaaagtgactctaagctgaggatgtaagtgaagcataggggtaaaagtgaagtgagggtgaagttccattctttcagtgctgtactgaggccagctggagtcctcctggtaggacttcatgcccaaggtctaattctctgtagtgctaaatgggtgaggtgagaggcagagccctgccaagggatcatggagggtaaagtaacaatggccttaatctctttcatttacagttagagaattttggttaaatctccatcactggctatgagtctaattttaaaaatttctctgtagttactgttttgttttcaaaatcctttgcattaggtaagatttgaaagatgacaagagaatattttgcttgcaacatcaccaagctaatcttacccagaatttctataagtcaaggggaataaaaatttttacaatgaaccacaaaggctcaagtccatagaacaaaatccagagcagaccagctttgctatttatctatttatttagccagctgctaaagttgaaatactttctttagatttttaaataggtaatatattcatatggttcaaaaaaagtctaaaaatgtatacatagtatgaacgtgtacagtttattgtgtcacttatacatcaataaaggtgtttaaaattgccacgatattgaaacttcagcaaatacatttaaataaaaaaaaactaaatatattcataatccttcttctaccattatcctccatctgcctgggtcccaaccctgccctctaactggtaacaacttttagtagtctcatctaatttattccaaagatttttttaaattaatatagaatgaagcacaaatatacacacttttccttctctttgttcaaatggttacaaagtatagacactgtcttgcatcttgctttttctttcacttacagtacttgaatctcatttttttcaacatttaattagaaaatgaatccatctatatttccatgggccttgcatatatgcatgtctggaaatctaaataaaacatgtagaaattcttttttttttttgagacagagtttcactcttattgcccaggctggagtgcaatggcgcatctcggctcaccgcaacctccacctcccaggttcaagcgattctcctgcctcagcctctccagtagctgggattacaggcatgcgccaccacacccggctaattttgtatttctagtagagatggggtttctccatgtcaggctggtctcgaactcccgacctcaggtaatccacctgccttggcctcccaaagtgctgggattacaggtgtgagccactgcatccggcgaaattcttaaacttaaaagataactccagctgggcatagtagctcatgactgtaatccaagcactttggaaggccaaggcaggaggatcacttgagtccaagagttcaagaccagcctgagcaacacagtgagaccctatctctacaaaaaattaaaaatatatgtatacacacacacacacacacacacacacacacaattttcccccctagaattacatactagagtacctaagaagctgacaagtaactcataatagtgtgctcaaaaggttagcaaattaaatgctgggggtcaccacagctggcctgttttatgacatactagttagagagtaccctctataactactctggcttaaaagaaagttaaaatgtgatggtgaacattcatgaagttatggaaattatcttttaaaggataacctaaagtcagcaaggcagtatttatcaaactgaagactggtaaccttaatcagggctactacacaaaaaactgcaaagtatcccaagttcaaaataaaggttttaaaagactatctaggaataaagataaactgagtcaacatcttagtataacaaaatgactacagatcatggaagaaaatcagcaaatctcctaaagaaataccatttctggtatatttttacctttcagcaaatgatttatgttttatattttataatatttaacacaagttgtataacaactttccccctttaatatacaattttgtctgtttttatatgtaatttatttttatttagattccatttggttacttatggaaatgtatttatgactataacagaaatcactggagttttatttcttgaaattcactctatatccaactctgcacaaatacggtgtatcaatgaagtatgctactgaataagttatgtttaagaactgtaagtctatttttatgttaaagtgaacaggtagggcctgtttcaactaagagaacaacataaagtctgtataaaaccagtatttgccattaattacttaaaaggaaaatgttttgtttcgatttttattacttgtacacttcaaaatttgtgcctagccagagaatcctttttttaagattatttttacgtgattatattaaggatcttcttctgcttcccagatgatttttctcttcaacttcccaaacatgatcctgggttctaggtcagtcatactgacactgactatatcccactcagaaaaaaagtgataatcgctcacacacacaatttttttctttctacccatgggttattttctgctggcagcaatagtttcatctgctactgctactgctgccctaaaacacccactcccaaggcctgcatcaaggcccacagcaggggatggggctccaggaggaagcggggggtcccactcagagaggcacaactccattttaaacattttcttttacaaagagaaattatcagggaaaggaaaaggatcccatagctatggggtgcttaacaggcctgttgagtgaggagagggatttagttttatttggttgggctagagctcaagttcaaattctcagtttatggaaaggatataatcaggtgagaagtttacttttattaaactacaagcctgacttaaattttttccctccaacaaaactgaagaaacaggcaacaagatataccgaaatgcctttcaatagagccctaaacacaggctttcaataacaggaaaaaaaccaatcaaaagggaaaaaaggagactatcatatctgcaagcaaacaagaactccttagactttgactgcctcaatgctacacagattaaagcaactttatctcataagctgtgggttaagataaacttgatagaaattctgagctctggtatttggcaaatatattcaattaaaaaaataaaaacaaacacaaaaaaccaccctcaccaaaatcaagaaagctaagaacttggtgcggcaaaccaccatggcatgtgtatacctatgaaacaaacctgcatgttctgcacatgtaccccagaacttaaaagtataatatatactttataatatgtacttttatttataaaagtataaaacaaagtaaaactacaaacttaatgtgctttttagctgcctattaatgtctgatcatatttccttacccaaaaattgaggacacatattctgacaagtgatggcaataatgagactgcttgaagcaaaactatttagatgatactagacctggagacagcagttatccgcaccgtagaacccagttgcctcgcactgacataccacactgttgaaagccgcccctccaatcagaggttcaggttgtttacatacatctcaaggacccacagataaaggctggaatagcagtcagccttcaaagactacctataatgcctgcgcttttaggcacaggccagcccaggcagaggccaaatctgtgagaagccttcaccaaagtttctgttcagggcaaggagcactcccctcctggtattggctcaatcagagctcttgtctttttcttagtactgcttcctgtttatgatcacctgtttcacccgcttccccttccctgacccacctgagctctcctcctccttccccctcccaaccttcctctttccctctgccacccatgtatgtatcctagacacactcctcctggcccacaggctccttcacctacccctctacacttaatgcttcctccagacacgctgcctgaaaactcaggaccctacctactgggagaggggccggtgtatggaggtggtcttgggagggtagaaatggaaggatccctggatgaagttactgggcaagaggaaatacggccagggattggcttaatctgagaattgaggagaaaatgttttagaagggtattttcagtaaaggtaggctggaggcaggagaagaaagatttagaacaagccaaacagaggtcagatggggattaattcgtgcatcctggttttcttgaacatctgccaaatcactataattcatcaggcctactgtaactaattcagtcaactaacaagtacttatttggcacctaatatgtgccaggcactgtgaaaatgtagcaataaatgaaaaaagtattcattataatttataagttattaatgtactgcctggttataaattaacaaggcaaaaattactgcctttctggagcttctaatttagtgatgggggacacgatcaacaacaaaaacaaaacatttcctatgatagacgccgataagaactagggagaaaaaatagagcaagagcaaagggtgtgcgggggtggctgttaaattgtaaacagagtagtcacagaaggccttaccttgagaacatgagagaggagagtggtaagagactgagctatgtggatacctggaagattgtagctttctggggccaatgaatatactagccaagataatgctgaattgggcaaataccaataaaagatgtggcaggtgttcatgctttgttcagaactatggttatatctattggaaatgatgcatttccaggaaactgaacttttgtttttgttgttttttgagacagggtcttgctctgtcacccaaggctggaatgcagtgctatgatctcagtttactgcaaccttcaactcctgggctcaagtgatcctcccacttcagtctcccaagtaactgggaccacaggcatgtgccaccacacctggctaatttttatttcttgtagagacggggtctcactgtgttgcttagtctggtctcaaactcctgggctcaaacaattctcatacattggcctccaaaagtgctgggattacaggcgtgagccactgtgcccggccaaactttttaaattaatggataaaactgtatgtatttatcatgtacaacacgatattctgaagtagatatacactgtggaatggttaattctactaacaagtgcattaccacacatagccatcattgttgtgatgagaacacttaacatccactccttgaatttttcaggaatactatatatcctcgttaactgtggtcaccatgctgtacaatagatccttgaacgtatttctcctaaataattatttactttcaccaacatctccccaggcttcccctccccattaaacatcccagcctttggtaaccattctactctctacttccatgagatcaactttttcagctcccatatatgagtgaaattacacagtatttgtcttcctgtgtcttgtttatttcacttaacacaatgtcctccaggttcatccatgttgtagaaaatgacaggatttccttattttttaaggctgaatagaatttcattgtgtacatatataccacgttttctttattcattcatattttgatagacgcttaggttgattccttatcttggctattgtaaatagcactgcaataaacatgggtatgcaaacatctcattttctttactcagtaatgggattgctggattatatggtggttctatttttaattttttttgaggaacctccatagtgttttccataatggctataaatagttcatatttccactaacagtgtataagggttttcctttctccacatccttaccaacactgatcttctgtcttttgaaaacagccatactaccaggagtgggatactatcttactgtggttttaatttgcatttctctgatgatgagtgatgctgagcattttttcatagacctgttggccatttgcatgttttctttgaaaaatgtcaggtctttcacccatttttcaaccaagttacttgctttcttgccattgagttgttggagttcctgatgtttttgaggtattaactatttatcagatgtatagtttacaaatattttctcccattctgtaggttgtctcttcactctgttgactgtttcccttgcagtgcagaagctttttagcttgacataatcccatttgtctatttttgcttttgttgtccatgcttttgaggcaggcaattgaacttttagcttcagtgtgaaaaaacatatatataagaaaatttagtacaatttcttccttaaaactacaaagagagaaactgtggttcctatacagtgcatttcttggcaaagaaatgaaaagaaatcctgtaacaagaaagattactattaatgttaatattatacattttttccaaccccacaagtgtgttgtatctactaagagaatcttagttttacaacatggaatgtagtaaaatatcaaagacacattaagcaagatatatgtgtgaaaaaagtctatacaaggaggtagtttaaaggatctttacattaaaaattttttaaatgctttcaaggttctctccttgtcagaaggatcaaatacttaacacaaggcctttacaagttagattactatattgaaggggttgataacactaaaataagtttataatctttatctattaatatatgcaccccctcctttagtccacaccagccccagaacaacaaaattccaatacatgaaagatatagtatactttgttgacaaagaactaattgactaaaggtattaagaccagagtaaacatctgaacaatttggaacacagtctaaggggagaggggttataatttaatttttccaaacaggactggaaggctctaggagcaagcaatggaatgcaacaccgacaccaaacttctcacccacctgcactcaagctcaagctcacaatagtaatattccataatttaatctattttaaatctcttagtactaaaataaataaaattagaatgctgaactacattctcctgaagataatttcaaaatggctcacagaataaattcaaagtgacttatggctgggcatggtgactcatgcctgtaatcccagcactttttcccagaatttttccaatgccaaaagtgtgttgtatctactaagagaatcttagttttacaatatggaacgtagtaaaatatcaaatacatgttaagcaagacatatgcatgaaaaaagtctacacaacaaggaggtagtttcaagaatctcctttaaactacttttgggaggccgaggtgggtggatcacttgaggtcaggagttcaagaccagtctggccaacagggcgaaaccccgtctctactaaaaatacaaaaattcaccagatgtggtggcatgggcctgtaatcccggctactcgggaggctgaggcaggagaatcgcttgaacttgggaggtggacactgcagtgagccgagatcacaccactgcactccaacctggatgacagcgtgagactcatcttaaaacaaggccgggcgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaacaaaacaaagtgacttacaagaaagtgctttatctttcagttaaaatacacatgaaaaaatactggaaaaggcctacatgtataagaaagggacagactggcttaagtaacttataaattatgataaatcctgcaacatggtatgcaacatttaaaaacgatggtgtaaaaatatacttattgacagccaaggatggtcatgatatattgagaataaagtcaagtctcagaacagctaggtaaaatagaacctcaaacacccacaggcatacaaacacatacgatggatatgtataaaacatagtaatagttttacttaggtaattaaacgtaattgtcatactcttttccataaccttggaaattatgaaaaatattaatataaggtcatgacatacattcagacccaggaactattaccaggtcctactgtactccttcttctcaggaccattataaaagtttgggtgggcaaaggttaagaagatgagaactgggcacagtggctcatgcctgttatcctagcactttgggaggccaaggcgggcagatcacctgaggtcaagaattcgagaactacttggccaacatggtgaaaccccatctctactaaaaatacaaaacttagctgggcgtggtggtgcatgcctgtaatcccagctattcgggaggctgaggcagcagaatcgcttgaacctgggaggcggaggttgcagtgagccgggatcgctccattgcactccagcctgggggacgagagcgaaactctgtctcaaaaaaaaaaaaaaacaaagaagatgaacaaatgtaatgtatggaaattaatgtttaccctcaaggtaaaagctgaaatggatttataaagaattattttaaacagcaataatgtttgaggggtgggggaagtgagaaaaatgaaattttaaatcacatgtttatgactatgaagctagactttaaaaataggtcagttagggtatgactcttataatacaaaagtttatttggtatacaaaggatttatagctaatgtattttttaattatattcactaatacttgtaaaagatcattcaatttataaagtttccaaaataaacctgtttaaagtgtcacaaatgcaacgcaagatgactttcattgctctcacttggaaaagtgcaaattcctctaacaaagtatatgcaatggcttcgtcactattctcagctcctaagcagacatgcacaacaaggtttgaacacattccaggcgtggccttcaagcccggaccacacctgcttccaaggccctgcggctaaaaataactctggggcctcaaaaatgggacaccagccaggcccaggggtagctgcaggccccttgctcagcttcaacagcaaaagcaggagctacaaaaactctaaaatcacagaacactccaccacaggcttccttctctcagtctctttgtgccagtcacctacaacctaggcctgctcagtttctttgctccatgagggcaaaactaaccctaggaatttagagacaagtgaggttattgtttttaaaagatactgtggactaggactcaggagaccttgttcctaatttcaactcatctactaaaatgctaaaatggcgtatacagtgtcacttgacattccccaagcctgtgtttttcctacttgtataatgaggaattcagtgatcactaatatctaaagattatttcacttagaacaaaaagatattgctgtaagtgtgcctcagttctcagcaaagtctcctaacagggacagggctgacttatcattaagcagtcatattatggtgtgagagtttataccctacaacacacaaactaaaacgggtaactctggggtaactgttccaggtaattcctttgtgacaggggattttcaaggcttgctctgagcaactatttccacttctcttccaatcccacagtatgcaggagacccctttggggattttgttactctaccaggtaaggaaaaaagaaagggcggccaggtagcagagaaagatgcagcaacagcatcgctgttcattcactgcaggatcctagtctgtgctaatttaagtcattgcatctgtccgcacacttccccctgctggggccctggaagttaatgatatcaggaagctgtatcaggagcaaagtaccacaaagtgacaggccaagacctaggctgaagaatcacagcaccacaggaaagcaaggacactaaaggctagcggagtagccccagacgggagtcggaacattctctgtcctcatcccttggttattttttccactttgtcctttccactgtctttttctataattcggctccatcacatcatctaactgtagtttctggacccttcttttgtccttagaggctttgctgtttcttcatcctcatattcatcttaatttctctcttcatgagtataaccaagcctcttcctgtctgatgttaagctcttatcatacattcattttctattttttgaggaggaactgccaagtcccttgatgtactgctattataacaagtaatattttccagactggtttgagacagtcacccgtgaattcaggtattttatcatctatcagcctttaaaatctttgatttgttactctaaaaaaaagttttattttggaggagaaaggtaaaatttttccagtttggtgtttcacacatggttggttatactaagtaaagatcatcaattcaatattttacatttatattagcccttaaatacctcatgttccagatactaagtcagacttccacctaagcctcacaggaagacacaaattctcaggattttcacactagattatttagaaaacaaacaagatctgaattattttataatctagtgctcagattctaaaagcagaaataacctctgcacatgcagaaaaagctggcttcatcaagagtctgcctggcacattaggacggacacctgtgccagtgctcagccgctcagccctgcccatcctcctccaccagcctcggtgagctgttagttctccttacctcagctcccagtaacgctgttgtctgattctttagaagggtttcccaaacaatcttaatagcaaaacaaatagtaatgggctatatcccatagaagaagataaatatcaatgagtctaaggggaaaaaaatttttttttacaaaacatctgcttctacaaatcaaagtttgagagaatggtgtttctatttgctattcttttttattttttcttttttaagaggttattctgtcatttttacacagtactatacttggccctctataattctgggtgtaatgtcagttgggttcaggcacattacctgcagcagcaacaaacaccttcctatcaaagtctcaatttcccactctaaaataccaatatgtcagtgttgaagttaaattaggtttctaacccaatgcagggaaaaagagaattgatggcaagtccttgatattaattagttgagtaaatgttgaaaatgacattttgaacaaatatgaaaagataacatgccggtcagatgtccagcaagccaaagagaaaggcttcctgaaaaatgtaaatttcaaagagagttttgaaagaaaatagggacatgaaccagcagagagaagagaggaagatgattccagatgcagaaaacgcatgagcaaagacagagggataacaaactgtatgcaggctttcctggctacagattatgtcaacaagtaacaaaataagttggtagagtaaaaggggctagatggtaaagaatcctgaagtctaaagccatctaggccactgtacgctttatgaaaataacataagaacactactaagagaatttcactctggtaactctattcagaatggactgaggtgagaatagatttaaggagactgactgactagtctccttacagtaccatacagttttagttgcctatggatgcgctcagtctagaatggtaactataaaacctgagagccaagagactgttaatagtctaaatccaaggcaatgtgcctggcacaagatatacccttattatatgtcatgggcactgaaagtacccatgaaaatggctatctagactacatgattgaattattgcaccagaataatatctgaaaatatctcaatgtcttattctgtcccagcttcacataagctaatgtaaagcaaaatgagcactatgtacaggctcaagttttactaattaggtcattgtttataaaccagaataattagacataataaaaggctgaaataggccgggcacagtggctcatgcatgtaatcccagcactttgggaggccgaggctgatggatcacctgaagttaggagttcaagaccagcctggccaacatggtgagaccctgtctctactaaaaatacaaaaattagccggacatggtggcacatgcctgtaatcttagctactcaggaagctgaggcaagagaattacttaaacctgggaggcagaggtcgcagtgagccaagatcgctgccattgcaatccagcctgggcaacaagaacgaaactccatctcaaaaaaaaaacgccgatgcggtggctcacacctgtaatcccaacactttgggaggccgaggtgggcggatcgcctgaggtcgggagttcgagaccagcctgacaaacatggagaaacccccatctctactaaaaacacaaaaattagccaggcatggtggcgcattcctgtaagcccagctactcgggaggctgaggcaggagaattgcttgaacccaggaagtggaggttgcggtgggccaagatcacgccactgcactctatctagcctgggcaacaagagcaaaactccatctcaaaaaaacaggctgaaataaaaggctgaaaaataggtagactctgaaggttgacatttcttcaaggatgactttcttcaatatatttttctgtaatttctaagtttcctattttatagataactttcataacagaaaactatatatatttttaataagacgtaactcatgtcatgtcatgaaaaaaagatgtggaagtcaaagtgaaacctaaatgaattttaatacactatcatgacattcatccaacagtgactatagtgtgagcaaatttttaaaaagtttttaaatgtaattacatagccctatgacagcaatgctacaaggtaaaagacattcatatgtattctacacaaagcaatataactatatatgattcagtaccaggcaatgttcctttgccaaatgtaaccttcagtatcaaagaacacatattcaaaattaaaattataagcaaaatcattacaaatacagtaagcttgctattgatgaaacttaatataaaccagaccatagaactgtctattaagaaactcaatggctaaatgccaaaatatctaatttcaccatctcatctaaaacatagtccacggcatagaccctaaaaatatgctcacaaagctccacagtctaattctctactggacagattatgaaatacattcaaaagaaacctatcaccatttgctatcaacatatttaagtgtcacataagcatcactaagtatcagagactgaaagcccctctaagtagaacacgataataaatgttcagttttttctcttgcaaatagtgttcattcttctaattctggggtgtggatcttagctaatctataaaactccaggaaaaaaattaaatgagttagtagaatatatatatatatgttcatttatcgagcaccaactagattcaatttcctatagcacaatttcccacttttgcctgatcacaagaatcacttagaaacttgataaaaatgcccaaccaggcccacctctggagattgattcgtgggtctagagtggaacctgtgaatttgcatatttaacaaatgtcccaggaggttcagagaatcaggcaggtttgaaaacatgcatccccgtgcgccaccacgcctggctaaagacatctatcctaaagacatctttggtctttctctcaatgttcacatttaatcagttgtcaagacctactgattttcagtctctcttacctggaggacatagaggcataaaagctggatttgagttgaaaataatggtaagaggagaaatgggaagtcagtcatgtcacgtcattaaagaaagtcagagactactgaaatttcatagccaaagaaggacttccacttagtctagtgcatgtcttctggcaagttaataatgtcccttttacaaaatgttacatatttattcaaagtcacactattcatcagtggtaaaagacagaaaatagcttctagggagtgtgctttccacaaccctagagagcttaccaaacattctgcaaattttaataggctcctgaaaaacacagaacgcaaaatatttcaaaagatgagaaataatgcacccttttaaacacttaatgggtgtggctgtggagagttgccctcaccaaaatgccagcctgccatgaagttacagatgaaatgccaggcatgaaatagagaaccaaatggtgaggcaacagcctcggcaggactctagtgaagggggaggaaccctcgaagcaaatgcttgtcaacttcctgggtcaccatgaaaatacagtaagacagttaaagtatgtaataaaatataaagcatgtaataaatgctcaggtaatcctcccacctattgtaaattctaacatttgctaaaaagggaacaactcagtacatgattaaatggaggagcattttggctaacagagtagctctgaaccttagttacacattaaaatcatctgggagctcttaaatatccagatgtacctcagaatgataaatcagaatctctgaggaatgggcccaggcatcagtatttttcacacgaacaagcagaggtggatcctttaccttctcctaaaaaactgtcacaagggacaggtcacttggaaggcagtttaagagagagcagaggagaaatctggtgacacatgtaacactgtgattaatctattgcttacgatgttttatatgttgaaagtctggaattctgaatattttattatgtaagagatccagttctccaatgtcacagcctctataatttgaataataataaaggagcacaacaattcacttatgatacccaacagaagactgcaaggatatgctggggcacagagcccaattagggtttaataagacagggtttatgggtgaagcaatctagtttccaatctttcttcttaaaaatctacaaatgtttaggtgtagatgtgtcaaggaaagattgttaaagcttgggagagatagagttcagtgttcaccggcttatgaatgcacgttaaataaatatctccacccaggaatttcccattactaacggctaatcaccatcacaagggcatacagccctttagaattcctctctaatccaatcctgtaaaacttcacttaggatgatgatggaaaccaagattcgggcctccagccaatctatattacattaaataaaggacgtcaccacccttctcaaggttgggccagcagttatttaaaaaaaaaaaaaaaaaggctgggcacagtggttcacacctgcaatcccagcactttgggaggccgaggcaggtggaccatttgaggtcaggagttcaagaccagcctgaccaacatggtgaaaccccgtctctactaaaaaatacgaaaaaattagccgggcgtggtagcatagtcccagctactcgggaggctggggaggctgaagcaggagaatcacttgaacttgggatgtggaggttgcagtgagccaagatcgcaccactgcaccctggcctgggcgacagactgagactctgtctcataaaaagaaaaaagaaaatgagaccaggagtttgagactagcctaggcaacatactgagaccccgactctactttaaaaaaaaaaaaaactaaaaaaaaacatcagccaggtgtgctgacaggggcccgtagtcccagctactagtgaggctaagcctgggagatggaggttgctgcaaggctactggggagcttgagcccgggagatagaggttgcagtgagctatgattgccactgcactccagcctgggccacagagtgagaccctgtcttaaaatatataaaaatataaattaaaaaaatttttaaagatggtatttaaccagagtcaggagttttcgtaacatattaacatccaatacaaggaacactaggttagaaaatgctcattcagctatttcccttgtacagtgggtctaacttgtgcttccttcacttacacaacagtttttgaacatctatactgtgcaaggctttttgctcaaggaatctttggaggatacaattttaaagcaatttcataagatatctataaggctccgtgagatcacatagcaagagtgggagagaaaaatttcaagtggtgacatctagaagtcaacaggaggaggtgaggaggtggtcaatcccacctatgtatttattctggacgctctcctaccccaactccttagggtgctacacaatctctttgtattcacaaataacccctggtcaagaggtttggagggagcggcgacaccaccagccagcaaacttctactaattctggaggcaacttcctgtcagctggtccctaaaggctggttgcttcctgccaggaggccacttagcacagattcatctttcttcaggaggcagacagttgcttttttttcttttcttttcttttcttttttttttttttttttttttttgagccaggagtctcactctgattgcccaggctggagtgcagtggtgctgatcatggctcactgcagcctcaacctcccaggctcaggtgatccccccagctcagcctcccgagtaactgggactacatgtgcacaccatcacgcctggctaatttctctatttttagtagagctggagtttcaccatgttgcccagactggtctcaaactcctggactcaagcaattgactcacctcagtctcccaaagtcctgggattatgggcgtgagccaccgcacctggccacttgctgattctcactgtggcactgattttagagggaaaggcagaggggaagacaattcatcttcccttcaaccccaggtacacacagtcccctgccccacacaaatacaaacatgaagaataaaagaggtacaggccttgacaaggttacactgacattatttccacccaacagtatctcccacaaagcgttaaggagggaaaataagaaactcttattaaaattagtctatcttattggaaggcccagtaaggtaggtaaatggcataaattctcaggagttggtcaatctatgatagttgtagttggaatgagctgtctgtctagacccatggtcttcaagcttttcagctgacagcccacttcagagtgacaaactaccaggtctatgtcttcctaacaactatttctctgtctacatgtgttccaccacaaaccctagagagaaataactgtgaaaaaaattctgtaaagtgagatataacatccagattaaaatgtaaatacaagagcactgaaaatgtatgcacatgtaacaaacctgcacatataccccaaatctaaaataatttaagaaaggaaatggacccacaaaaacttgtataaaaatgttcacagcagatttataaacagccaaaaaaattaatcaactgatgaatagataaacaaaatgcagtatatccctactatggaatattatttagccatgaaaaggaattaatactgataccagctacaatatgggagaaccccaaaaacgttatgctaagggaaagaaactagataccaaagaccacatattatatgaatccatttatatgaaatacccagaaaggctgggtgccgtggctcacacctgtaatcccagcactttcagaggccgaggtgggcggatcacctcaggttgggagttaggtactagcctgaccatggagaaatcccgtctctactacaaatacaaaattacccgggcgtggtggcacatgcctgtaatcccagctactcaggaggctgaggcaggagaatcccttgaacctgggaggtggaggttgtggtgagccgagatcacgccattgcactccagcctgggcaacaagagcgaaacttcatctcaaaaaaagaaaagagaaaaaaaaaaaaaaaaaaaaagaaatacccagaaagggcaaatgcatagggacaggaagtaaatcagcagttgccaggggctgggaggagtgggaaatggtgtatgacctaatgtgcagagtttgttttgggggtgatgaaaatgtcctagaattagatagtagtgattactacacaactgtgaatataccaaaaaccactgcattgcacaccttcaaagacgaattttacgactgaaattatatctcaactttttttaaatggtaaatttggtggtatattaattgtatctcaataaactgtcatttttaaaaagggcaggcaggccaaggcatgactccagatgtaaagaaactaaagacacaagtaaatgtagaacacgatcctcaattggaccctgtatgcaagaccaaatatttgtgtccccactaaattcttaaattaaaaccctaagtccattgtgatagtatctgaaactggggcctttagagggtaattaggtcatgaggtggagccctcatgaatgggattcatgctatataaaaaggacccccagagagctctctttcttgggtatacgatgagaaattggtactctgcaacccagaagagggccctcaccagaaccagatcatgctggcactctgatctcagacttttagccttcagaactataagaagtcaatttgttatttataagctacccagtctaaggttgttatagcaacccaagcaaactaagactgtactagacagtacaatgctatgaagaatgtcgttgtgtcaacttacaggactgaaatacacgtgtgggctagttagaagtattaaatcaatgtcaggtttactggggttgacaactgtactgtgggtaggaaactgtccttgttcttcggagacctgctgatgtgcttgaggatagtgggccatgtgtacaacttatggttcagaaaaatgtatcatatataaatatgaagagagagcaagtaataaagcaaagggggcaaactggtaatagtagatgctgttcttttatttttttctgtaaatttaaaattattttcaaacaaaaagataaaaaagtaaatagaatacacataatctgagatctagaaattctacttccaataatttgtcttatataaatacctgcccaagtatattatgtgaaatacttttccctgtaacatgtttataactgtaaaaagaaacaacttcaaagttaatgagtgataaattggctaaatatattattatatcaatgtagtataccatatggacatgtaaaaagaaagatgtctatctgatatagaatgacttccagaaatatattcttttgtgaagagaaaaaaagaattggtttatccctagaaacaaaaccaataaaaaactcaagaagcctaggaatgtttggatttggttaagaaagaagctaagcctgttctatttatttatgaggccagttatttgtatttgtaatacaaataattttctcccttacagcattgataatacaagctttactaatgaaaaaggaaactaatacaatcttgtatgccacttactcctgtggttaactcaaagcatttaaaaataaatttcgtaaaaactcaagtataacatatatgccaataagcatacacaaatcatgaatgtacagctcaaagaatttttataaggttaacacactcatgtaatcaccatcctgatcaagaaatagaaacccacctgtactccagaagttggcttcatatgtcttcctactactaatctctctccccaaaggtaaccacgaacctgacttcttataccatggctgagttttgcctgtttttgagctcttttgtgtctgaactgttttgtacaaaattatgttcatatctatgttgttgtaagtagcaagagttttttcatgttcacttctacctagtatctcattgaatatacaacaatgtatttatctattcttccactgatggacatgtgggttgtttccagcttggagttattatgaattgtgctgctatgaacattcttgtacatgtcttttggtgagcataagtacacatttctgttgggtatacacctaggagtgggtttgctaggttaaacgcataagtatgtaacactttagtataatagatacaaccagttttccacagttattccaatttacaattccagaatccatacatgagggttctagttgctctacacccatgctgatactggtattttcaagtttttgtttgtttctcaattttagctactctgatcagtgtgtagtggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactgccatatgaattttagaatcaacttatataaacttctgtaaaagtttcaggtatctttcttagatttattaccagcatttgatattttttgatgctattataaacagcatctaaacatttcattttctgattactgttatatagaaatataggttttgtataataacctcacatccagtaatcttactaaatttatgtttactttgagatggattctcgctctgtcacccaggctggagtgcagtggcatgatctcagctcactgaaaacctctgcctcccaggttcaagcgattctcagcttgatgcctcagcctcctgagtagctggggctacaggtgtgcaccaccaagcccagctaatttgtgtacttttttttttttttttttccgtaaagacaaggtttcaccatgtttaccaggctagtctcaaactcctgacctcaggtgatccgcccgcctcagcctcccaaagtgctgggattacaggcatgagccaacacgcctggccactacatttatttttaaagcattattttttaacttacataaagtaaaattaatgctttttggtgtacagttctatgagttttgaccaaatgtacactgtaatgtaaccatcaccacaatcaagatgcagaacgtttccatcgctccaaaaaattcaaaaacaaatcctggtcaaatcttaagttaccctaataacagataagagagtacatggataaataaagtctaacgatatcctataaactacaatctagccaaaactatatgacagcttcagtctcatttcctggcaaatctttccccaccaaattcaaagccggtaagagaaatggtaaccaaatcacagttctagagccataatgtaccaatctaatatttaatatgtggattctgaatatctgaatggaaaagaacttgttataaatgatattgatgtaataacagtaacatcatgtacttttagaaacccaaatgaaattacactataaaaataagttatatttcccatgcaaaataaatggataatgaaaacatctgagagttatttatacaatattataaatttatgaaatgctatcatttgggggggaaattctgcaccctctggataatgattatgttaatgaattctggtctactaatgatcacccatggtttagttttatcttttttactttacctgtgtttcgtggttgtgttttttcacaattaaatgtccagcctatgctcagagggatggatggtgataagtagccccaaagggcctagataatattttgcaatgaaactgtcagtgctaccaaatatatttcaatccttgagttactgtataaccaaagttaagaatgaatgaacaagggtggctctgaccattatggcaactttccacaatgtagttctttgaagctgcctcagtccttccattacctccgctatttacacacccaggtgtttttagtattttgtaagaagggactggtaatggtcaatcaagacctggcaataggccagaaagcaatatagatgtcacagatggtcaagcacaaagacaacactagatagacatgctgtgttctagtgtaagcactaccaacatctcatgcattctgagtcaccctacatattgcttacccattcctatttggtttactggattttgcttgtttactttattcctcctatagtattgtcagcatgagaacattttaagtcatggcaccatatggcaataatatataactccataactaaaataagctccctaaagactggctatctgtcagatactatctataagacacaaaaaattaaaaacatcaagtgcttgaaacctaaaaataattttatcttagcagtacccttaagcctcaaccacaatcacattatttcttacctttaattaacatcatgatatcattgtccatatgagagccatggacaacaaataaatcagtttagaaatacttctttatacctggcatgaaaatatagctgttcttaacagaaataaaaattcactgaatttggactggtgttttgtttgctctatgtatttaaaacaataacaggccagtgcagtggctcatgcctgtaatcccagcaccttaggaggccgaggcaggtggatcacctgaggtcaggagtttgagaccagcctggccaacatggcaaaaccccgtctctaccaaaaatacaaaaattagccgggcgtggtggtgcccacctgtaatcccagctacttgggaggctgaggcaggagaatcgcttgaacccgggtggaggttgcagtgagccgagatagcgccactgcactctagcctgggcgacagagcgagacttggtctcaaaacaaacaaaacaaacaaacaaaaaaaagcaaaaaaaaaaaaaagaaaatacattgtccaatgaacttttcaccttctacttccttatgactgtgagtaggcttaaaaaaaaaaaaaaaaaaaaaaaaaagcaaaacatactactgtgtatctccagggtaagtacaagctctactactccaggccatatccaccataggacttgtgtacagcagcattaaaaaaacaaatatttaagcccaggattctgaggtgataccatgctataagcaggaaaataagtaagatcaaaagttagaaaatcaaagatccaacaaagctttggtggagtgctaccttctagctattggctggcaacaaagatttctcagtgtagaagttagataatactgagattccaaggaaatcttagacacaagaggttagctggtaaaaggcaatgcttgcaaaatttacaattttagagctggaaaaaccttagatatcacctagtccatccctctggtttacatataatgaggagagggaagaagaagagaatcaacccgagccctccaaatcctctttggagtatgaaaccctgactaagcagtaccagtaatagcagaagaagcagagatgacagttactgtactccactcactccatttttgtatccctgaactatatcacatctaatctgtgagttctaagtagctgattcacattaaagaaaaaggcatcctacaactcaacaacaaaaaactcaaataatccaatttttaaatgggcaaaggactggaataaacatttctcccaagatgatatataaatggccaactatttgaaaagatgctgaacatcaccaatcaccagagaaatgtgaatcaaaaccacaatgaggtatcacgtcacacccattaggacagctaaaaacaacaagtgttggctgggcacagtggctcatgcctgtaatcccagcactttgggaggccgaggcaggcggcctgaggtcaggagtttgagacaagcctggccaacacggtgaaaccccatctctactaaatatacaaaaattagctgggcctggtggcacgtgcctgtaatcccagctactcgggaagctgaggaaagagaatcacttgaacccaggaggcagaggttgcagtgagccgagatcgcaccactgcactccaacctggtgacagagtgagactctgtctcaaaaaaaaaaaaaaaaagaaaaagaaaaagaaaaagaaaaaaaagaaatattttgcaatagatctcttcctttttcttgctgtgttcctcccaacctttaataatctaaaggtgtcaagaactgctccaggatactatcttccttctcccaaaccatcctacagaagcggccagctaacatactgctcttagagtaagcagggcaggtctgcaatcgtggagaaaaggggaaatcatcaggaggggatttcaagtgggttgtcctccacttctaatcatgatcatgactttatccctcagcctatgaaaagcagagactagggtgacagaccccaagctgaaaaacccctagggcaaaaaaatgagaacactgtactgagtgtactttaattacagacaatacacacatatgtatatctttctctattaaaataaaaatacaattagtctttcattttcaatgaaatatgagtaactgcccaaaacccaaaacctaattttagctttagcctctttaccatcgacatcattattagggatacaacccagtcatcaagatgactgaaaaagtggcactgctgctttcccctgtgtaactgaatacacaattcctactaacagaaatggaatactggtaagttgctaaaaggcagactatctagtatagttattttaaccgtgttttgatggaaatccttcaattatatgtgcatctccatgactcctgttgcacccacccccgcacttccctagtcccattcttccaggcccagcacatgggggagcccagctgatcctggagtcttcctccgtgccctccatgcttagctccactctctgtccacagcctcattttgcctatagctatttccataatcactaatgcctactccattcactcttaccattcttctttcatttatcttctgccatcccttagctctcccaaaagaaaaaaataacagtctccccacctggatgaaacaaatgactgccaagagcagtccgttctcctctcacatatgttaccatctctcccattctgtcattcaagaaaaaaaataactcagtaccctggattttgaatacaataagtaagtatgaacagatatgtgtgtatatatgtggccacagtgcttttttattaaaaaaaaaaaatagggagagcaaattttcacttttttatgttataaagtgctctcactgactcttcccttctgtctaccctttatccaacacgctctgatgttatatgaccttccacccataatagtatctggccacatggctcatcctacacactaacatagtcccttctccctgacaaattcatcaactaagatggacatgttactttattgatttagatgcgtgtatcagaccaggcgcagtggcactctgggaggctgaggcaggtggatcacctgaggttaggagttgaagaccagcctggccaacatggtgaaaccctgtctctactaaaaatataaaaattagctaggcatgatggagggtgcctgtaatcccagctgcttgggaggctgaggtgggagaatcgcttgaacccgggaggcggaggctgcagtgagccaagacggcgccattgccctccagcctgggtgacagagtgagactccgtctcaaaaaaaaaaaaaaaaatgtgtatcagactgctctaaaaagatgtcagcacatggtactagtttacaccagcagttttcaaagtgtgatccagagatgaggaaggaaccccttcaagggatctataaaactatttttgataatatgaagatgttatctgtctttttcactttcattccctcatgagtgtacaacagtgggtcgaggatgcacggtatgtggtgatgatgtatctatcactctgacagctaagaaaacatatacttgtatattctttactgcctatcattttttaaaaacccagtttcacccatcattctcagcaaagtaacacaggaacagaaaaccaaatagcacatgttctcactcataagtgagagttgaacaatgagaacacatggacactgggaggggaacatcacacgctggggtctgttgggagggaaacatcacacgctggggtctgttggggattgggaggatagaggagggatagcattaggagaaatacctaatgtagatgacgggctgatgggtgcagcaaaccaccatggcatgtgtatacctgtgtaacaaacctgcacgtgctgcacatgtaccccaaaacttaaagtataattaaaaaaaaaagccagtctcacttaacaacatccttgataaaataataaaaggtattaatttttaaaacgtcaactcttgagaacttggcctttttcatattctgtatgatgaaataggaagcacacataaagcatttctgctgcatacctaagtataatgattatcttggggaaaagcatttatacaatttttttttttcataggacaccatttttgcttttttgactagcagacaatttacacttattcagactttggtatctggcagacattttctctaaaatgaataaagtgaacctgtcactttaagaaaaaccggcaatattgggctgctggccgtggctcacacctgtaaccccagcacctcgggaagcctaggcaggcagatcacttgaggccaggagttcaagaccagcctaaccaacatggcgaaacccccatctctactaaaaatacaaaaaaaatcagccaggcgtggtggtgcgtgtaatctgagctaggcagaggttgcagtgagccaagatcacaccactgtactctagcctgggcgacagagggagactgtattaaaaaaaaaaaaaaaaaaatgggcactatctgttgccaatgatataaattaagctttcaagagaaaactggtattttggaaaacttgaattcgccaccaagatcttgaccacttcccaattcttaaagattttttggatgagactgatggtgatattaatgactgtgatttgcttaatattgtataatcaaatgtgccaacatttcaaagatgtgcagaacttagtaaacctttttttttttttttttccgagatggaatatcgctctgttacccatgctggagtgcagtggcacgatctcagctcactgaaacctccacctcccaggttcaagcaattctcctgtctcagcctcccgagtagctaggactacaggcgtgcactgccatgcctggctaatttttgttatttttagtagagacggggtttcaccatgttggccaggctggtcttgatctcctgacctcgtgatccacctgcctcggcctcccaaagtgctgggattacaggcgtaagccactgtgcccagtcagcttagtaaaccattattttttgaatgatcaatgtatgcagttacaaaatcacacacaggtcaaagatccattcaaagtgcaagatggaccagtggattttaatgttacagagtacacaaaattcactgacatggcttcagattcagcagtgcaactaatatttaagaatctggctgggagcggtggctgcgcctgtaatcccagaaatttgggaggccgaggcaagcggatcacttggggtcgggagtttgagaccagcctggtcaatatgctgaaaccccatctctactaaaaatataaaaattagctgggcatggtggtgcgtgcctgtaatcccagttacttgagaggctgaggcaggagaatcacttgaacccgggaggcagaggttgcagtgagctgagatcacaccactgcactccagcctgggcgacagagcgagactatctcaaaaaaataaataaataaataaaaagcatttaccaattgttgaattttggtgtaacaaaaatattcacaattatatgaaaagactatgaaaataccccacccttcttcaactatgtatccgtgtgcagccaggttttcttcacgtatttcaaccaaaacaacatatcacaacagattgaatacaggagcaattatgcaaacccagctatcttctataaagaaatatactaaagagaatggcaaaacgtaaaacaatgccatgtttctcaccagatttttttgtgtgtgttggaatacctttttcataaaagcatattatttatatcaaccctctttgttttttcttcttttttttgagacacagtctcgctctgtcgcccaggctggagtgcaatggcaggatctcggctcactgcaacctctgcctcccgggttcaagcgattctcgtgcctcagcctcccaagtagctgggattacaggcgcccaccaccacacctggctaatttttgtatttttagtagagacggggttttaccatgttggtcaagctggtctcgaactcctgacttcatgagatccactgacctcagcctcccaaagtgttgggattacaggcatgagccaccatgcctggcctaatgtttgttattttttaaataaataaatattttaaacatttttcagttttaatttctaatgttaagtatggacagacatagtctatataaacaaaagatttttggggtcctcagaaatttttaagagtataaatgtgtcctgagaccaaaatgtttgaaaaccattagtttatagtaccacaaaaaaatagcacttttaagtatatgtatacaagagaatggacacctgaatatgaatcagaagatcttggctccaattctagcaccacttcttacttgctttaggatttcaataaattacttcatctctctaaggccttagtttcctcatctgtaaaatgggtaactcatgtcttccaaggataaaagagacaaaatatgtaaaagcaatttataaactacaaggtacactattattacaagatctcaaagttaagcattttaaacacttcttatgatgttttgtttctttgtttttgaaacagggtctcactctgttgcccaggctggagtgcactggcactaacatggcttactgcagccttgacctgccaggctcaggtgatcctcctacctgagccccacgagtggctgggactacaggtgtgcaccatcacacccagccaattttttgtattttttgtggcgacaaggtttcaccatgttgcccaggctggtctactcctgacctcaagtgatccgcccacctccccaagtgctgggattacaggcatgagccaccatgcctggcctcttacgatgtgtctatgaaattttccttattcttaaaattttattactaaaaacagaacttatagaaaatgtcaagtgcaggccaggagcagtggattacacctataatcctagcactttgagaggccaagacaagcagatcacttgaagtcaggagtttgagaccagcctggccaccctggtgaaaccacatctctactaaaaatacaaaaattagctggtgtggtggtgcacgcctgtaatcccagctacttgggaggctgaggcaggagaattgcttgaacccaggaggcagagattgcagtgagctgagactgcgccactgcactccaacctgggtgacagagtgaaactgggtctcaaaaaaaaaaaaaaaaaaaaaaagccaagtgcagacttttgattagctaattagctcaaatgtccaagcatataattttactttattttattttgcagagacagagtctcaccatgctacctaagctggtctcaaactcctgacctcaagcgatcctcccacctcagcctcccaaagtactggatcataagaatgaaccctcatacccaacccaacaacacaattttattgcatttaatttcttaccctacagttataattggttatatattttaaatcattattagggacatttccaaatatacacaaatgtaaaaaaaataacaaactccaacttacccattactcagcttcaacaattttcaaaaatttatcaatactcttttattcatttcccacttctgtgtgtttgtgcccatcctgaagttttttaaaatgaacatttcgcatcattttattctgcctgtaagtacatccatatgtatttttaacacatgaaaatattttaacataaccacaatatgactattatagctgaaaacattatggttgtaactattaaatatcacctaatatatattccattttcaagtttcccaactgtctcaattaaaaaaaaaaagtctttgttagtttttggttggtgggtattatcaaaatatcattcttaccaattctttctcaagtcaacccaagatgtttaactaaagctacgaaggaagaggaaataatactatgcttcatataccatgtacagtttacaaaacaagtcaagaactatcttctcgaggaattttcttttccaccaaccaaacaataacaacaaaaaccaagcaacaacaacaaataaacccactacaaaataagccagcatggcaatacatataccttagtattctgagaagtgatccaaagagcacacagctcagctgctcgggaagagaaggagctgttacactgtgagccgaaaaaggtgactggaaacaaccacccatcattttggaaaagaagaagtcaggtcagccacagggtcaaagctggaggtgaggtcagagaccccgttctagagtgagcacatggctcaaataagagtccatgcccaagactataagtcaaccccttgcaaactgcaactcaaagctcaaaacacagtgctctaagctagagatataatggaacggctataaaaagcaacaggtgtaagaactgactgaaattatttgacaaacatttgtcaaaagcctactctactatcctgggatataaactgtgtatttaaaaactagtacaacgcacactgtaagtagcatatacttctctacacatctttccccatttattttaagagaaataatggatatattaaatattaattatcttgccataccattacatcttttttctataaacgcaatttgccccaccccaacatacatagacattaaaacaaacctgaattcttctgtctttcccaaatatttttgaggagtacaagtcagattaacttttattacacataccacagacccacagcatttatagctgtaattcttttctaaattaaggccaagcatggtggctcacacctgtaatcccaatgctttgggacgccgaggtgggaggattgattgagcccaggagttcaagactagctgggcaacatagcaagaccctgtctctacacaaaataaaaaattagctaggtatagttgcacatgcctatagtcctagctatttgggaggctgaggtgggagaatcccttgaaccgaggaagtcaaggatgtagtgagctgtgatgacaccactgcactccagcttgggcgacagagtaagaccatgtctcaaaaaaataaaaattaaataaattaagcatttagtttaggaggaaatcaagagagcactaaagaatttcctaccttgtattaaaattgtttcccataggtttatctcaagtattttgtagatgaaaattggttaggtgcatacagaataattcttgagggatttggttctatagacacacttaatatcaacactttttaaaatcctttacctcaatttcacctataaaaaagttttgctggtcacagtggcttgtgcctgtaatcctagcactttgggagactaaggcaggaagactgcttgaagccaggagtttaagaccagcctgggcaacaaagtgagacccccatctctataaaaataataaaaataaataataataattagccgggtgtggtggcatgcaccacctgtggtctcagctacttgggaggctgaggcaggaggactgcttgagcccaggagtttgagactacagtgagctatgattgctctattgcacttcagcctgtgtgacagagacagaccccatctttaattaaaaaaaaaaaaattaaaaactgcaaaaagagtgaagggcacatatttcttaaagaatgcttcagaagaacaaaatgtgccccaaaacatgaaatagctcctgataatatcagtttttagttgaccactatgaaggacatcttctaaacaataacaaaacaaacctggcagtccaataactacaggaaagatcaagacttccccattttggaacatctttgcttcaggtttttactttttgtagtaatacaggaacaatatgccatagggacaagagttgaacaggtgtcatcccttaccctattttacctattggtaattaagcctaacagtttattgtctgtacatcttttcttttgtatgttcccatacaaaacaatctttggaatttagcttcactttatgacactatggtgattattgttcctaacagagagtctaacctaagaatatagcccaatacgtgaaaaagctaactgaacagtaaacaatgacattaatctcattgtaaaaaaacatgagattcttagcaaatggcagcaaaagaactgtggatacattaacaaggcattaaaaaaaaaatttaaagtttctggccgggtgtggtggctcacacctgtaatcccagcactttgggaggccaaggcgggtggaacacgaggtcaggagatcgagaccatcctggccaacgtggtgaaaccccgtctctactaaaatacaaaaaaaaattagctgggtgcggtggcacacgcctgtagtcccagctactcgggaggctgaggaaggggaatcgcttgaacccgggaggcggaggctgcagaaagccgagatggcgccactgcactccagcctggcgacagagcaagactccgtctcaaaaaaaaaaaaaaaaaaatctaagtttccatgctttgacctaaaaaaaagtcacataggtttctttttctttaattcccatttctttttttaaaaactggttaatgtgtagatttttattcaaattcatttggactgcacatgaatattaaaaagttataacatgaagactgttcattagactatcataggcaaagcaagtgattcacagaataagtgcaatttatcgaccctgatcattacctttactaccgaccactatttaacatcacttttttaatgtactgtttacttgtttactgtctttgtttattgtcctgtcttctcccactagaatataagttacgtaagggcaaaaactttctcttattttccactgtatggccagggtctagcacttggtagaggatcagcataaatttgctgaatgagatgggtgaataccttccgcctttcgcctcccccacttccctctctccatacacatgttaaccaatctttaaggccagggtcaaattctattatctctatgaagattacctccctgagccctctttctcttttgtacctgaatttggcacttgccagctgtctggtaattatctttgcatatgtatgtatctcccttaaaattcttataatcctgttctccataacatgggccagtgtccccaacttttggaatccatctcagcacatgtaaacagcatactgctaacaaatgttttgcttgattcctatcagtagttaatccagaaattcagttaataatttcagtttataatgtatccctccctttcaaataactcaaaataggccatgatattacagcgaatccctctttttatttctgacaattttaaattttacattctcatataagtaatgctcataatttaccctatcaatcactatccctcaagattatatgtttttttttttttgatacactgtcttgctctgttgcccaagctggagcgcagcagtgccatcatagctcactgcagccttgacctcccaggctcaagagatcctcccacttcagcctccaaagtagccggcaccacagctgcgtactactaccatacctagctaattttttgattttctgtggaaacaaggtctttgttgccagggctgttctcaacacctgagctcaagtgatcctcctgccttagcctcttaaagtgctgggattataggaatgagccaccacgcctggcctacattttttaatgtaataaaaaaatcttgtgactttgtggcaatacctataatgatgtttctaaccccagtcaagaagggcgtgaagtttcattcctctctcttgttgctgaggtatcagagggcatttttccacttattcctctttcctttcatggcaagatgtattctgttcccttccttactgatcatactcctggcaagcttttattatttctttgtacctgtccaaggtaatctgtcttacatccttcttttgagccactgtttcctccagttatttatttgattaaaattctaactccctgtctcaatccatttgtgtagaagaaccagctcttcttaaagcctgagcctgcttctttaaattcggccaacctttatgaacctctcttcacacagccaacccttgatcatcaaggataatgaaatgcatacaaataacagattgtctacaacacaagaaaatcagaaaaaaaaaattgacatctggctttggaatttatcatatgtagctttgggcaagacttattttcctaattatgtttttgtttaagccaacattcggattttcttttatgatggtgaatatctccgttttaaatgatcagtaaatttcttttaaagccaatcaagcaccaactatggtttttcctgtgaaatctttttaactagtttctttcatctgttgaaatctgtcataaaatctgttttatttcctctaagttatctccttattttcttgggattctgatccaaatcagttcaccctatattaatttacttcttcaaattaaagtaccttttgcttgagaacttaatgcattttaaaaacactgaatgtccagtgaaatttttagttcaggtaacacgaagtagaaaattatttttgtctaggaaaacttgggagttctaggataaattattacactggtaattctagcaaattatatttagtaggatttttaggattagctgaaaattgaaaaaatttaatactggacagctatataagtctgcttcatcaatatattaatcccatatgctaaacactgtatgaaattaaattcccagtccagggatttacagaaaatagcatcaaaacacactaacacataaatcctgcctcttattctgatccctacctaaactctgcaaccttctcacacctactcttcccccctcccatctcagcctcacttccactctcaactgtcccacaaataatttttaaacgtgtaggaaaaaggaaaagaaccggggtaacagtgtctcctcttttactgccttctcagttactgccattaagcttttggcccaaagactccaatccccaattttacatgtctatttttattttataggtacacacttacaatcaccaaactgaacgaaaggatagggcattctaaattgaaaaaggagcaaaactggataattctgcagttctgttcctagccccctccataatcatgcactatgatcatttggcactataatcaagccaaatgagatattgtactttgagttgctgatatagcagaggttaatactaaaaaagaaaaaaaaaattaattaccacagtttacattttttatctgaatgtacatttatagtacttgaaccgagttattttcaaaacactattcacactaacaaaattcaaaataaattcatttctaatttttcccccatgtagaattttgataagtgcaaaaattattttacctaaaatccaactcttgggctggtgttatttagcctatatttttacataagactgtaaatgttagccaaattaaaaaaaattttaatgcaactttccacattgtcttcaaactcagtaaattccacaattttaaaaaacaaaaacctttcaccgtgcctactcacatttttactaaaatccctacacagagccatacattctgcttttcattttacttctccaagctgctgccttcaccaaatagactccacgagcctcccaagtggtatccaccaatatatgtgatactcaaggaaaagtaggtattaaagagtaattaattcaattggtacgaaatcttttcttttaaaattttaccttaactttaaaaagcccttttcttgatggaggtgaaacagcataaatcctttgaggaaacggttatcctttacgtggactctccatcagccccataaggtgagtggcataaagaggcatttttctgacagtctcagttccccaaacactagtcctaaacttttgcatggatggtaaatttcacacacacacacacacacagaggcggaaaagaaagaagagaaagaaacatacctggtttattttctaaacaggtttgataggtttggttcacttgaaagagcagagtatttacttataatcttttaaaacagaagtgggagccagagcgctgggtaaataaaaacttcagagagttttaaaaccctgcatcttaactcacttccctttggttcaaggggatggcacagcaaaccccacggcaaatgagattatgcaacaggtttttttcctccccagcttattcatcacaggctggttagaggtgtgctttctccaatctgagacacccacgacttcaaaacgccaagaatccttgcagttgatgtttcctaaacttctttaggattttgcagtatccattcattttcagatctacttgccttttctctggttcattattggtattctttaggaaataaacccagcatctgaaaatatttccctctgtggtgtttcattacatgaaactacacgtgatacacagaccctgggcttttttatttctcacgttttgcagctagtgtaaataaagaagtcactaggcgtcgggccccccaacgccaagacccgagcccctgtccgaaaattgagggctttttcggttggttggttgaagaaagcagcaccgtcaccacccaggtggcctcgctgcttacaccaaaggcgaactggggataatgggaacagtcaggccagggccccacttggcaggcgtgttgtgtaacagtcgcgcctggaagtgagcagcttcgcccgcaaaggtgccgcgtcccgcggcggccgctcctctcggcggggcccggtccaagcgccgcgcagcggccgggagcgcacccactgcgaccccgcgcccggccgcacgcccccttcccgctccggccagcctccggccaggcctacacccccgcttcaaacgctcctgcggcccccggccgcggtcgcccccacgccgcctcccgaaagggtggccggtacgcccgggaaggcagagacggcggggctggagcgcggcgcccggcaccgggagtcggggcgcgctgcggagcgtccatgcggccgggcgggagggcgccccgggccccgcaccctcccgcccgcacaccccgcgcggcccgccaaggccacttacttttggggccgccgacctcccaattccctcagagggaaacgaaagttgtcacggcgtctcccctcgggcccccctcgcctcccggacttgcgaggcgccgccgcggagccgagagggcggctgcgctcccgctcgcgtcccgtcccgtcgctctcctcctcctcttcttttcagtatattatcttctccttctctgaggggtgggttggggcgggaggcttaggaagagaggagacgctcgcaacttttcttcactctttctcttccaccctcccccccatcagccttcaaaaaaaatgtcgaaagagatgaagaacttagggaggtaaaggtggggggccgcgttgtgaaagtgggggttgggggggagagagaggtggtaataatcgtttaaaaactgattaaagccccccaaacactgatacatagaaagagggggaaaggcgggggggtggggtggggggttgggggaaagagaaagagtcgctggtcaggaaacttcaagcgcggatgaggtcattggtttaaaaataaagagatggcgtcacttgaaaccaatcccagtgaatgaactcagcggagccccggggaaaggaggagacaggcgagggcagggcggtgggcgccgggcggggccgcgcgctcgcccatcccgcggccgcccgagcccggagcgcggctccgcgcctcgttccggccgctcggggaggggtcaggtcatgttcccttccagagtccggcgactctgaggcaggttccgcgggcgccgctgggaggagccggagctgccggaggaggcggccccgcggcctcctcccccacctctccctcctcctcctcctcctcccgcgcccgcgcgcccgccccctacccccgggctcgcggccccgacccccgggccggggtgtccgcctccagtgctgcgccccaacaggtatcggagggttttctccctcacccagacgcagaacctttccctcctccttgagctgtttccagctgcctcaccaacgtcaaaaaacgcaaacactgatttgagagaattacactcgctctgtaaaaagtctggcgaatgcaaaaggcaaggctctgccatctctcaggagagaagttacaggtacttcaagaaaaatcacactactgttgtcaggcattcagctatctatatgtttatggttgaaagcccccacataaatgttcctacattactttactttgcttatatttacaaatacaaggataagcagcctacattttctttaaaaatgttttctacaggaggcagcgcagaaacatctttaaataagaccaggggttaaccgcctcttgagaggtacaaaacccttgttgatttaactccacatacctcgtgcattttattatttgaattcattaaaatgtctgttttgagatgacattatgcactttggaaaacgagagacctgaggtggtgacaaaccaggacttggaatcactgaataggacaatcggagctttattccaatgttctttgagcatttgagcatgaagctgcttctactgagaagtactcacgtggatatcacataacaaagatgtgattaatgacggaaaagcaccctgcgagtggactgctccatgagccagaatttatgtgtaggaataatctaactcttcaaatattccatttacaatgtgccggattgggacactagaccctaaaggcactgtttgctgtgggatatccatgtgcaccctgcctaaagcacgtttttccactagcaaaagaactgataagcaggtttgggtgggttcgaaagataatacacccctgttactacttttctgcctttaagtcctgcaactaaaggcattccttatgattggtaatcattgaaggttagtgttgcggggtatggccctgggaacttctggcccatcttttataggagggaaaaaaaaagcccatttgaagatgggaggcaccctagcacctctggcagtagtaggtaaagcctgaaggccacagatggagaagcaactttgagcctgtgcctctggcctcttgaagactttgctaggggaagcaaatctctcccactgctccctgtcctctggtggccaggaggtgttactgcagcttccttgggattatttgtgctctaccaggaaacccctaaaaatctaactgtagacctttgttggaggtgttgggatttttaggaaggaagaagaagatagtccttttactagtggtacagagcatggatcttgcctggaggaaagattcatgagaattaatggtatcccctttgcatgccaaagttccagtaaccttgctttaactgacatggcttgaaacgtttctcccctttcctcagttacacaattaagtttgtgtaatgtatgatgtggtgccatcatagctatcatagaagtctctcagggtatttcatctatttctggaaacaagacgtatattaaagctcattaaaaacgaaatcaatgattgagtgatgtacaatattggttaaaagagtcagggggccgggcgtggtggcttaagcctataatcccagcactttgggaggcccgaggcgggtggatcatgaggtcaagagatcgagaccatcctggccaacatggtgaaaccccgtctctactaaaaatacaaaaattagccaggcgtggtggtgggcgcctgtagtcccagctactcaggaggctgaggcagaagaatcacttgaacccgggaggtggaggttgcaatgagccgagatcgcaccactgcactccagactccagcctggcaacagagtgagactccatctcaaaaaaaaaaaaaaaaacaaacaaacaaaaaaaaacatcaggggagaaaaggagcaatgtaggctgggattatcagggaaggcaccttataaagagttttgaccttatccttgaaggacagttcagatttagtttgcagtgaagaagccagtggagggaagattccagagggcaaatggcaatgagccaagacatggaggtggaatgaataatgagtaaggtgtattcaagtgacagaagagtaaacccagtagcagtagaaatcggtatttagcaattaggtatgaggttaaatttaagagatacagaggcacattgtggaggtacttgaatgttagaataaatagattgttacctgcccagcaggtgaaggggaaaccactaaacaagtttacttcaccgaagagtacatttctttcttttactaagaaaggttttctacatactaacaataaatatgtggaaacagccctctccctctcccgctcccgctcccgctccctctctttccacgatctccctctgatgccgagccgaagctggactatactgctgccatctcggctcactgcaacctccctgcctgattctcctgccttagcctgctgagtgcctgcgattgcaggcacgcaccgccacgcctgactggttttcgtatttttttggtggagacggggtttcgctgtgttggccgggctggtctccagctcctaaccgtgagtgatccgccagcctcggcctcctgaggtgccgggattgcagactgagtctggttcactcagtgctcaatggtgcccaggctggagtgcagtggcgtgatctcggctcgctacaacctccacctcccagccgcctgccttggcctcccaaagtgctgagagtgcagcctctgcccggccgccaccccatctgggaagtgaggagcgtctctgcctggctgcccatcgtctgggacgtgaggagcccctctgcctggctgccccatctggaagtgaggagcgtctctgcccggccgccatcccatctaggaagtgaggagcgcctcttcccggctgccatcccatctaggaagtgaggagcgtctctgcccggccgcccatcgtctgagatgtggggagcgcctctgccccgccgccccgtctgggaggtgaggagcgtctctgcccagccaccccgtctgagaagggaggagaccctccgcccggcagccgccccgtctgcgaagtgaggagcccctccgcccggcagccaccccgtctgggaagtgaggagcgtctccgcccggcagccacccagtccgggaaggaggtggggctcagcccccgccaggccagccgccctgtctgggagggaggtgggggggtcagccccacgcctggccagccgccccgtccgggaggtgaggggcgcctctgcccggccgcccctactgggaagtgaggagcccctctgcctggccaccaccccgtctgggaggtgtacccaacagctcattgagaacgggccatgatgacaatggcggttttgtggaatggaaagggggggaaggtggggaaaagattgagaaatcagatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccttaatctcaagtacccagtgacacagacactgcggaaggccgcggggtcctctgcctaggaaaaccagagacctttgttcacttgtttatctgctgaccttccctccactattgtcctgtgaccctgccaaatccccctctgcgagaaacacccaagaatgatcaataaaaaaaaaataataaaaaataaaaaataataataaaaaatgtggaaacagaaattaaaaacagaaccattttacaattgctccaaagaacgtgaaatatttacatataaatctaacaaaacatgtacaacatctgtgtgatgaaaattataaaatgctgatgaaagaaattaaagaagacaaataattggaatggcatactatattcatggattggaagaatcaataaacatgtcatttcttcccaaattgatctatagagttaacgtaattttcatcaatatcccagcaaggttttttgtagtcataagcaatcttaaactaaaacagtgtccaacacatctagaggactgagtgagtgctagactcccccaagacagaggaagagcacatacacttagggcaccagcaaggcagggagtccaaggtttacaatcagataatctagaaagaagctatttttgcttcagtacatgtaagtgtgtggtttagtactgttttttagttagagttaaatatggggaaggagcaccaaaattgctggttagaattaaatatgggggagaagcaccataatccttagtgtttagaccctcttaaggtcttacttaatccatccctggctgaagtttattcattgacaaacagtgattgagtgcctactacccttatgtgccaggcactgcacctagctctgggaatatggttataaataagattacctatctctcatgaaactaacattcaagtggagagagaagacaataagccaataaacaaaaaccacggcctggactgtgacaagatggactacacagggaaaaaaaactgggtgaggtgatagtgagtgacttggggtaggggtgaaggtggtgggggaagttcaaatgaagaggggacatttgaactgagaccttaaggatggcaacaggggaagtggtcagggtagagaaaacaggtcactctaagaccgttcagcagaaacagagtgacttgtagagagttggtgtgttcccagagccaaaggaagccagtggggcacaaaagtataaaacaagggtgggcaggagccagattatgtagtaccttatagtgtatggagttcagattctattctgaaagatttaagcagttagtacatgatctgatttatgaagaggacatttgcaattaagtaagcataaaaggttgcgttttagagagttgggttttttttcaagcagataaaagcctgttttgtttgaatggtctatgtaattactgaggccactatgtatagacaagaaaggaggagctttatctctcggtctcttcctccttggacaacatcttgatgatctcctccttcttggcctggaggcactcgtcatgaagtttgcacacttccttagtcttaggccagtgggcctcagcctggtccaccaggagcttcttgcgggacttgtctaccttcagcttgcggacaattccatgagaatacgcttgtttttgaacacaatccctttcaccttctggtacagagtgtaatacatgtggcaatcagtcttcttagattcacagtatcttctaagaagctggcacagaatcctcattctccttatccaggttaccttccctggcctttgggcattggctgtaccttcttgcttacctatgcccaggtgcctgcccttccgatggtccaaggttttctggcatcaaggagcctgggaatggacaggcacaggcttgcggatgatcagcccatgtttgatcagcttctggatttgctgatgggagttaacattggtctctgggagccaaccagaccttctttttgccacagcaaaagacattagaggaaaacttcctctgaagcctgagcatatgcatggcttcagctgcagcagcaaaaacagttttaatattctctattttttaggtaatataacagctcccttttccaataggaagagagagtttttgacaattttgttaatctccaaggatcctttgaatgttcctaagtcaaatgttcttagcctaggatttgtggattcctagagagtatatagatgggctccagagggtctaagagccccctaaaattttgtgtatatatgcttatacatgtttttctgtgagtgggtccctagctttcaacagattttcttttcttttcctttttaatgagatgaggtctcctactgccgaggcttgagtacataatcatggctcactgcagtctcaacctccagggctcaagtaatcctcctgcctcagcctcccaagtaactaggactacaggtgcaaaccactatgcctggctaatttttaaaacttttggccgggtgcggtagctcatgcctgtaatcccagcgctttgggaggacaaggcgggcggatcatgaggtcaggagatcaagaccatcctggctaacacggtgaaaccccgtctctactaaaaatacaaaaaattagccgggtgtggtggcgggcgcctgtagtctcagctactcgggaggctgaggcaggaggatggcgtaaacccgggagcttgcagtgagctgagatcgcaccactgcactccagtctgggcgacagagcgagaccctgtctcaaaaaaataaaaaataaataaataaaactttttttctgtagagatggggtcttgctttgttgcccaggctggttttgaactcctgggttcaaccatcctcctgcttcagtctcccaaagtgctggggttacaggcatgaaccaccatgcacagctgcaacaaactttcaaaggattttatcacacacacaaaaaaagtgaataagacctacttcacattaaagtcttggctatacttctgggatagtagctgctactgttatcttagggttcatgacactgaacaaattacagttctagaaagaagcaagttctgcctcagagatgacactatgttggaggagggcaatatttacagcaaagtaggaaggaacttcttggaagaaaaatgttaacctgcgtgatgtgagaactagaagatacctaggaaattacctggtaccatctcacattacatgtaagaaaatgaaggtccaaagaggttaaacgacttgcccaaggttgtatagctagttagggactaaaaaggaattccaaacaggtcaccaacactcagcacagcactctgtgctccccatggaaaggtatacaaagaaactggactattgagctttaaagtttaataggaaatatgtgttaaattttattcaactcaattacacaagtgcatgctcattcctaaggaactggaaggaaagagggaagtaaaggagttcaaaaatgtgtaagttctcagtcctgaaggagatgaaaaacatgaatgttaagatgtacaatcaaaacaaagtaaatagcagtaacactttttttttttttttttttttgagacagtctcgctctgtcacccaggctggagtgcagtggcgcgatctcagctcactgaaacctccgtctcacaggttcaagcgattctcctgcctcagcctcctgagtagctgggattacaggcacgcaccaccacacctgggtaatttttgtatttttagtagagacggggtttcaccattttggccagtctgacacctgaggtcaggggttcgagaccagcccggccaacactctatattatcagtctatatctgatctttctgcagcagatttgttaaacagactcaataagttataaaaactagacaatttttcacttatcaatttggcagttattttaaaaaccggtaatcccacagttgagttaacaatatggagaaacagactttctcattagcactggtgagaatataaacaggtataactcttctggagggcagtttggcaatatgcttatgaaagtctttaaaaatgcatacccaacaattctactttacgaatttatcttggccgggtgcggtggctcacacttgtaatcccagcactttgggaggccaaggcaggtggatcacgaggtcaggagatcgagaccagcctggccaacatggtgaaaccctctctctactaaaaatacaaaaattagccgggagtggtggcagatgcctataatcccagctactcgggaggctgaggcaggagaattgcttgaacccgggaggcagaggttgcagtgagcccagtgaaccaagatggctcccctgcactacagcctgggtgacagagctagagctagactctgtctcaaaaaaaaaaaaaaagaatttatcttaaggaaatgatagtactattttcaaagacatgactgaggatattaatcataataaataatagctagcatttattgaatattacctcatttaattctcataactattaatcttctcagtttacagttaacttgccagtgggacacagtggctcacacctgtaatcccagcactttgggaggctaaggcaggcagatcacttgggctcaggagttcgagaacagcctgggcaacgtagccaggcctcgtctctacaaaaaaactttaaaaaaattagccaggtgtggctgggcatggtggttcacacctgtaaggtaatcccagcactttgggaggccgaggagggtagatcacctgaggttgggggtttgagatcagcctgggagaaaccctgtatccactaaaaaaatacaaaaaattaaccaggcatggtggcgcatgcctgtaatcccagctactcgggagactgaggcaggagaattgcttgaactcgggaggcagaggttcagtgagccgagatcgtaccattgcactccagcctgggcaacaaaagtgaaactctgtctcaaaaaacaaacaaacaaaacaaaaaaaaattagccagttggggaggcacatgcttgtagtcccagctactcagagactgaggcaggaggatcacttgagcccaggaagtcaaggctgcagtgagctgtgattgtgccactgcactccaggctgggcaacacagtgaaaccctgtctaaaatatcaaaggatttggacttttttcaaggcaagcaatggaggagccattgaaaaatttttaaacaagaaagatcagattcacacttttccatacagagaatggttaggtggggcagacgtaaagcaagacaggaaacaactgtacgagttagagaaccaaatggaaaagagaagacagatacaagatgataagctagaatcaaaaggaccttgcgaccaattagacatgagctattaaggggaaaagcagtgtcaagggtaactcccaggtttctgagcaaatgagtggatggtggtgctgcttattttgggaagagaaaaggtaagaaattgaattttaagcatgtcaagttcaaggggcctatggaacctcaagaggagtgagttattgcatttatcaatgtccgaaggtcagaggcagtgtctgggtaagagacaaggattttggattcattcaccatattcagttgtagacatgaatggcggatgtgaccacagggaaagtgaagcaaaaaaaaatgttggcaatcaagggaattatgaggtttaaagaagctcataggctgggtgtggtggctcacgcctataatcccagcactttgggaggccaaggcgggtggatcatctgaggtcaggagttcgagaacagcctggccaacatggtgaaaccctgtctctactaaaaatacaaaaattagctgggcgtggtggcgcatgcctgtaatcccagctactgaggaagctgaggcaggagaatcacttgaacccaggaggcggaggctgcaatgagccaagactgcgccattgcactccagcctgggcaaaaagaggaaaactccatctaaaaaaaaagctcatagggagactgagaaggagaaactagagaagtagaaaagaaagcagtgaaaatggctgttacagaaagagagccaagaaagtttcaagcagggcaagagtgtgtttttggtgggttaatacctcagggaagtcccctaaggtaaagatgaaaatgtatttctttgatttagcaataaattgactggggagagagtggtttttgctgaaggcagtcttgcaaaggcaagattgcaatgagccgaagaaggagtaagaaggaataaaatggaaactgtgaaatataaaccactgtttcaagaagcttgttcagagaaggagaaaagtcggataatcttgttagaggcagatgtagaatatttaaaccctacaaaaatcctaatgacttgccaagcagtctaaggttttgttttgttttaataaaacaattcataacaaatagggattagacaaatgagaaatgagaatttcttagttgcaatctcaggagagatttttactacttacagccgaaactttattttcagtattagatggaacacacacttacagctcttgtcagggtattttgacaagtcttttaataaaagtgaagtaaaatatgaataataatagaattgtcatttctaacctcaggtgtatttatcttttaaaaggctgaaaattacttttataattaaaaaaaatagtggtagtagggaaaaaagtaaataaaaagctaaaaagattagcagttgcttataatttttctcaattgttgattcacaactcaccaaaaatttaaatttaagtggcaaatacctatttttttttttttttttttttgagtctcactctgtcacccaggctagagtgcaatggcgccatcttggttcactgcaacgtccacctgccaggctcaagcaatcctcctgcttcagcctcccaagtagctagaagtacaggaatgcgccaccacacctggctactttttgtatttttagtagagactgggtttcaccatgttgcccaggctggtcccgtactcctgggctcaagtgatctgcccacctccgcctcctaaagtgctgggattacaggtgtgagccaccatgcctggcccctgtctaatttttattctgcctccacaattatcctaaggattatgtccaactctcacaaacttcagaatgaaattaaatctaattcagtttagcaagtaaaggtcttacagcacctttactagaaagtctatgcagaaaggccaggtgtgatggcacatgtgtgtaggcctacctactcaggaggctgaggtggaaggaccacttgaggcctggagttcaagaccaggctgggcaacatagtgagacctttgtctctaccaaaaaaaattgtttttttttaattagctaggcatggtggcatgcacctatagacccagctactgaggaggctgaagcaagaggattgctggagcccaggagttccagattgcagtgagctaagattgtgccatagcactgtagcccgagtgacagagagagaccccatctccaaagaaataaataaataaataaataatctgtgcaggaattgaaaaattaaagaatggtaataaagatgctgtaaaagccaaaaaattatgaacaatttcttttttttctttttttttttttttttgagttggagtctcactctgttgcccaggctggagtgcaacggtgtgatctcagctcactgcaacctctgcttcccaggttcaagtaattctcctgtctcagcctcccaagtagctgggattacaggcatgtgccaccacaccggctaatttttgtatttttagtagagagagggtttcaccatgttggccaggctggtctcgaactgctgacctcaggcgatctacccggctcagcctcccaaagggctgggattacaggcatgagcccctgcacccggccgtatgaaccatttctttaggtgagttttgcttctttttatctgaccctgaagaaaataattggaatgaatacagtaattcccttccccttcccctttccctttcttttcgacagggtctcactctgtcacccaggctggaacacagtggcaccttcatggctcactgcagcctcaaccttctggactcaagtggtcctcttgccctctgagtagctgggactacaggcatgtgccaccatgcccagctaatttttgtttgtttgtttgttttgtagagacagagtcttgctttgttgcccaggcttgtctagaactcctgcactcaagcaatcctcctgcctcggcctcccaaagtgttgagattacaggcatgaaccactgtgcttggcttcctttttttctgatataaataatctgttttttaaaattgctgtttttgaaggccagagattttttaatgtttttttcattttctgagtaaacatatgtctcagtgtactaagtttttaaattcacagtggctttctggactaacagtgacaacattcagtcacaacattcatgtttataaatgtaaacatttaccttaggaacagtctttaaccagtaactgaacctcttgttcaatgttggttaaacagcaagatgggatattctgaccaaaaagcagaaaaccgattttaattaaaaatacttttaaagtttatgtagtcaattttctattgtcttgacacaaaagatctatacctctagtttaggtcactgagttttaagaatatctcggctgggcacagtggctcatgcctgtaatcccagcactttgggaggctgaagcaggcagatcgcaaggtcaggagttcaagaccagcctggccaacatggtgaaaccccatctctactaaaaatacaaaaattaactgggtgtggtggtggatgcctgtaatcccagctactcgagaggctgaggcaggataactgcttgaacccaggaggccaaggttacagtgaccaagatcacaccactgtactccagcctgggtgacagagcgaggctccgtcttggggaaaaaaaaaaaaaaaaaatctcaaaccactatagtggtttactatatttctagttactataaagaaactggaaatgtaatggatttgaaaataaactatcatcatgtcaaatcaaatacaccacaggcagctcttttgtacaaggaatattctgggcttttaactctcataaccctcaagagttagatattattattttgtattttacagtggaggaaactgaggctgagaaaagttaaagagtttgctcaaagacaaatagctagtagcaagttaggactcgaacccaagttttcccaaaaggagcttttgttgagaagataaacaaaagtacaaatataagttaccaccaacaaaaattaccacaaacttagttaaaaataacattataggaaatgccactatattagaaagcacttctgtgattactggtaaaacgtatcattcagatatgagctacaaaagttagaaaaaatgagaacttgctgacctggggcagaagattcagccggcaacaaattccagcttcaccacacactggctgtgtggcttgagggaaacatagtctcctcatctgcaaaatgaagataacatcaaccttccagagttattgtgagggttacatgaagtaccaagtaaagctccaagtagagggcctagcacacatagtaaacactacatactgactccttccttcttaggaaaggctctccttgggtctaagaccttgaacaatagattgagttgggatattgaaagagaatggggaagctcatttcaggaagaaaaaagaagcagaagtcagagatacagcaggaaaaattgggtttaaaatagtttacctgatgcagaacatttaaatttaagggtatataataagcctggaaagcagtttgggccaaattacatcaggcctcagtcaaagattttagactttatattataagtagcagggaatgacggagagtttggttcctttgtttacattatgctttattgaccttatgttttattataaagcaatacatgttcattgtagaaagtctgtaaattggccgggcgcagtggctcatgcctgtaatcccagcactttgggaggcagaggtgggcagatcacttgaggctaggagtttcagaccagcttggctaaaatggcgaaaccctgtctctactttaaaaaattaaaatttagccgggcgtggtggcgcaggccaagattgtgccactgcactccagcctgggcaacagagcaagagactctgtcacaacaacaacaaaaaaaaaaaaaagaaaaaagaaaaaaaaaatctgtaaattacagagaagtgtgaagaaaaatatacaaaacaccttattcaatagttaccttgagagataaatttttttattgttttatcctttggtggaattttttttcttttttcagtagctttactgaggcataattgacaaatagaaattatataattcaaagcatacagtacgaatatttgatatacatatacattgtgaaatgattaccacaatcaaattaattaacacatctttccccacacacagttactattttcctttggtagtattttgattgagttttttttttccacgtacatttgttattttaatactaataataaaatgtataagtacatggaaaacattaaacacatttacataactgttctttttataagaagatttgcctctcaaaaaaggatttgcatatttgagatggtcagatggccagtgagagttccccaaggctagaaccacacattttatagggtacaatggttgctaatctttatatgcatcttggcctatcatttcaacatatcgttgtaacacatttttcttttatttttaatatagctaaattatttaatttctttaaaaaatattgctatcataacactctccaaagattacctctggggacatttgggtgtatctttttcagtttgaaggtttgaacttgaagatagatggaataaaagtgggactttaggtggcttactctgaccaaagcaaattagaaagatgcgaggaaggagattatagaacaaggaagaccatattgggctatggtagcaattcaggcataggtcaataggtcaaaaacgggcaagactggtacagtgacaatggacatggaaagaaagcaacaaacacaagtaacaatacagagggagaattgacaggacttggtgactcacgagctatggagggtgaaggagatgagtaatgaaagatgatgctaaggtgtcacctttggcaatttatataaatttcaatttcctcatctataaaatggggttaacaattgtaccttcctcatagggttattgggaggattaaatggatgacatctaaaatgcttagcacaaaaacaggaatgcattcttagccaatagtggctgtcatagtttttatagatgttgaatctacatggctgggtttaagaataatgaaattcttaaataggaaagtcaggagaaaggtctgattgaggtagagaggtagagttgagctatagtttagacatgtcagatttaggtttatggtggacagttgattaaaaatgttcagcaagaagccaccactggcagtgatgtttgacagtgggtacattttaggaagacttcatgttcatgagaagcagatacctggagggtggataccgctgcacaatgtccacatgtctgcccgtaacctccacttaacgatcagaaattacctgatctaataagcaatctctacatatcgtacacttcccggctgagtggctctggtaggacagataccaaagtagtgaagcatttaaaggttttggaaccagacagatctgtttgaatcccgactcttccatttactgttgtctaattgcaggaaaaataattttcttagcttcacgttttcttatttacaaaatggagtaataaaaatttctacctcatagcattgatgggagaattaaatgagactatttaaaataaggtcaggcatggtggctcacacctgtaatcccagcaatttgggaggctgaggcgggcagattacctgaggttaagagctcaagaccagcctggccaacatggtgaaaccccgtctctactaaaaatacaaaaatatgaacggggcctggtcttgggcacctgtaaccccagctactcagaaggctgaggcaggagaatcgcttgaacccaagaggcagaggttgcagtgagcagagaacataccattgcactccagcctgggtgacaagagtgaaactccgtctcaaaataaataaataaataaataataaaacataaaaataccaagttgttttgttttgttttgttttgttttgttttgttttgaacagggtctcactctgtttcccaggctggaatgcagtggtaccatcacggctcacggcagcctcaacctatcccaggctcacgtgatcctccacctcagcctcctgaagtagctgggaccacaggcgcttgccactaataaactgttaattgttgtactttttgtagagacggggtttttgtcttattgcccaggctagtcttgaactcctgggctcaatcaatctgcccgcctcagtctcccaaagtgctcagccactgcacctggccataaataccaagtattgctattaatcatgcctctccttgaggttaatagttcgtttatatttcctctccattctttacggtgtcaaacatgagaggcactctctgctaactgctgatcactgtgcctccacaactttggttttcagcctctccccatggctcagttctttttggaactttgtaactcatagtttcgtgaaattccagaatgccaaacagcatctttggaggaagatggtctgttagtctttgtttggagagaacttctgtattagtttcctatcactgcttaaacaaattaccacaaacttagtgactgaaaacaacacaaatgtattgtctcacagttctgtaattcagaagtacaaaatggtctccctaataaaatcaaggtgtcagcagggctgcattcttttctggaggctctaggggataatccattccctcacccttttaagtttctagaggccacttgcattccttggctcatggccttcttcctccatcttcaaaaccagcaatagcagcttgagttcttttcacctcatcaaccatccctctggttcacttctgcctccctcatctcctattaaagacccttgtgattatattgggtccacctggataatccagaatgctctccctatgttaagatctgctaactagcaaccttaatttcctttgcaactttatctctcttgccatgtaacataacataggacaggttttgagaattttgatgtgaacattttgggggaccatcattttgcctaccgtaccctccacaaagaaaactccagggagatttgcccctgctttgtctctctgtcttgcaggacctaactgatcctctaaatcatgaaccatctatcacaatatgataattgcaataatcacaattgggaggcctttcatgataatatttttcttctggtctaagtctgattctgttccatgcttaaagatttatttgtagctaaatacaatgactgttaactaaaaattcataaagaaatagtgatcttggccaggcacagtggctcacgcctataatcccagcactttgggaggccgaggtgggtggatcacgagttaaggagtttaagaccagcctggccaacatggtgaaactccgtctctactaaaaatacaaaaattagccaggtgtggtggcagtcgcctgtaatcccagctactcgggaggctgaggcagagaaaaaaagaaataatgatctcaggaaatcctttccagtatgggggaaaaaaaggtttatcatcaaccattcacttttataaatgatatgaatgtccatttctttttttcttcaagtcagagtcttgctcttctgtcacccaggctagagtgcagtggcccaagtacagctcacagtagcctcaacctgccagactctagcaatcctcctacttcagcctccctagtagctgggacaacaggcacttaccaccatgtccagctaattttcgtatttatttatttatttatttatttatttatttatttatttatttatttatttgtaaagagagggtcttactgtgttgcccaggctagtctcaaacttctgggctcaagtgatcctcctgcctcagcctcccaaagtgccaggattacaggcatgagccaccacacctgactgaatgtgtattttatttctgaaacaaaaccactacacatgattgttaccaatatgtttctattttttttttttttagctgggtatacctgtaatacctgtagtcccagctattcaggaggctgaggtgggaggatcacctgagcccaggagtttgaggctgcagtgagccatggttgtgccactgacggcatgacagagtgagagtttctatttttttaacagaaccccaacagcggtgctttcattttagatccaattgatgattaatggacggcagagtatgtcttaagaaagacaggtgaaaaatatcaggttgcaaagcaaagcacgtaaatataccaaagccagaattttttttatttttgtaaggggtaaaaggccatgagtactattttaggagtaccaaaagttcaaacactgtagttggaaatggataaaacctcaatacctttgaatctgacactgaaatttagtatttctatcttttaagttcttttatctcaaggtatataaaagtgctccaaataaatatgtccaaatcttgggattttctttttttttgacatggagtttcactcttgttgcccaggctggagtgcaatggcgtgatctcggctcaccacaacttctgccccctgagttcaagcaattctcctgcctcaggctcccaagtagctgggattacaggcatgcaccaccacgcccggctaattttgtatttgtagtagagacagggtttctccatgttggtcaggctggtctcgaactcccgacctcaggtgatctgtctgccttggcctcccaaagtgctgggattacaggcatgagccaccacgtctggtgagcattaaaaattttgttataaatttcagcattaaaaaatgtgttaatggttgatcctaattttctagtgggtaggaggttagctttagtacctgattgaaagaaaacagcttgaaaaacaggagaggctagcactaaattgttttatgactttgggcaggagactcaagagaaggaaaatagagagcccaacaggtattgagcatctattattgccaagcactgtgtttgcatatattatttccctgagtttttacaacatttcctgtgggtcgccattgttacactttaaagatgaggaaatcaaggctctgagatgttaacagactctcccacaatcgcacagctaaagggtaacagcactgggattagagtccagtactgcctaactccaaagcccatgcatatgctttccaccaccctcagctgctcttgccttgtttcctcatctacaaaacaagggagttcagtcagataatctctgatgcccctcaagttctacctgcatggcctttgtggttgggaggagaaaggggaatcagggcagggtctccggcactgtgctgagtggtcttcttctgagtgggaaagcaatgaaaccacgtgtcttactggtgctgtactgactccctgtcctgtgaaagaaggctgctgctgctggcaacactgcaaatgacgatgggactcccaggcccacagccctcaaaaggaagtgagtcttctcattctcctttgcagggccactttttataaatttacatttccaaaaccaaatccatcaacatttactgttgagaattttattgtgcccaacactgagttaaatggtattgcaaggctctatatacaatagcaaggaagtataagatgtggtctgtattctcaggaacttacaactagctgggagaacacaacacacaaagcaatttttgaaggacactgtataatgcaggactgaattgtgtagtccagatgatatgtactacaggagtgcagagaaatgggcgttcagtgggggctacagcacccgtgagaactggagcagagacaacgttattcaccttgcattcttgactagtctttcttggccttttctgtaattgtgaaaccctggtatgactctttgacatagttcaaacattctctgctttgcaggctgcagtgatgtccttcatatcacgtcatcttagtgccacttcatctttattggcatgtgtgggaggaacaaaaccccagtggtatgcaaacaccgtcatggggacttgcttcaagccatgggaagtttcacgcaaagccagtttctcagtagggcaaatgttgtgtaaaagtacaagaagtttgagaaactagttaaaggcaaagcctgtcacagcaagaatgagatttgaatggggacactttcctgtctgtgtcagggatggtctgatggtctactcccagcccctcaccttcggagcccctgtgcttaagtacttcgctgacaacatggcccagaggcgaaaggaccttgtccaatgcagcaggaacttcttattcccaaaccctctgcccaccctcataggccagtcttttgataagaggctgtagacctgaaaaattattctagaatgttggatctaatagatttaatagtcactatatatttactgcatgttctgaaacaaggctggattgaggactgttttcatttgagctgaagacacaaaatgaatatacaggaaacagcagctaagtgtacctgacagattaatggcatcaagtgctaagccaagggtaattggttcagaaaaatgagacactgataagtacagaagtaatgagggaaagtgtcaccaagccaacgtttaggagagaccttaaaaaatggaaagaatctggattggcaggaaagagaaattatgacattctagaaatgatatagtacctactatttcatgtgatgaattataaattataataggaaaccattatcaaaggcaagaaaagtgaaagatatattcatggaaaaccaaagcagtcagcctgtctggaggaagggtggcataagaatgtacatagcaaaaattaatgggaagttaagatcatctgaataagatgaattcatcaacatacttaggctgggcacggtggctcatgcctataatcccagcactttgggaggctgaagtgggtggatcgcttgagcccaaaaattcaagactagcctgagaaacacagtgagaccctttctctacaaaaatacaaaacaatttagcggggtgtgaaggtgtgcgcctatagtcccagggagtatagtacttgggaggctgaggtggaaggacagcttgatcctgggaggtcgaggctgcaagtgagctatgatcactgcacaccagtgtcggtgacagagtgagacactgtctcacacaaacaaacttaccaaacatatatcaagtgctgattacactaggtctcttgctgcataattataatagtttacacctattaaagcttacaatgtgccttgcactgtgttaaagtgctttacatatattatctcatttaattgtcacgacagacctatgaggtatatgttacctcataggtaatgtatccattttacagatgaaactgatgaaacccagagaggctaaggaacttgcttcaggtcacatagttactgagtgggaaagcctagtattgaaccaagtaagtcagcccaaacacgggttccgagcacaatgctaaactgtctccacagatattactacaatctcataaacttccctatgacataggtattatcaccccagttttgcaaatggggattcaaggtttcgagagtcagtgaattgcccaaggtcattctgctgagtacggggctaggatttgaaagcagatccactaactccaagtccattaaacttcccattacaatatagccacctggcagaaatattgtctagtatgagatcagattagaggaaattttgacagcaaagaagagcaagaagtctatatgaatagggaagaacttcagggttttgaatagacatgatttgattaatgaaggtagtctaggtctggcctcagtctttcacaggtaattgaatcagggaaagggtagacatgaacagtagatgatattagaggaagtaaggacctagaaatgggcataggagagagggaatgacagaaacaagatcaatatttgaaggaaaacctgattgttctaggggctgaacagctgagagtgatgaaagaggagatcaaatcaaagaggaatttgcttctctatatctaaataacttcatggactattgacagggactgacagtttatatgagcagctgatttgtggcaaaaaaaaaaaaaaaaaaagaagaaggttgtttttggacatgttgcaatctgcttggcagaacaatgacctgcacattccagaggaaatggccagtaggcagtcagggaaatgggattggagctcaggtagagagcagaagctgtcaatagtatctgacaaataagctctgcaaggaccactgaaggggcagacaagtcacatcccaagaaaaatagggtttttttttaataatcagaatgcgccaggagtcagcagagaaccaaaatgcactataatgaaagagatcaggcccaagggcaagccacaggtcaagataagtggttagggacaatgcagagataaaaattaaagggatgcagcagcaaatctgatctcatcagtatcaaggataaatgaccacagaataatttcctgtcctgtttctggtattttggggtattcccctattgcaggagccaaatccacttaactggatgacgccctcagaatgaccctgcagaacaaccaggaatcttcctagcagggagtacacagtctacatcagcacagggagagaatgaaagttatcaaaaagggcctctccactgaattgtacatgtaaaaatggctaaaatggtaaatgacatttatgtagattttaccaaaatttaaaagggagtctatctcttgaaaagataaacatctacggattcccccaaaatctccaaaagttcacctaattaccatctcctggacttcccctgtttgttaaagatcttgatttccttgcttaagttggtggctatggtgctaaagggatgaagatacttaagaaaccatggaggctgcagctacctggtgcccttgtcccttccagtctgggaagggaatgggatagttggttgtggtcagtttgctgtggaaactcctcttctggcctttctgctccctctgtccttttttcagaactttgagaacatgacacattggccaatgctccaccctctgtgacctcttctgcttgacacaattaagaaaatgagccatagagcaactcagccaacacctggaagggacttacctgagacaggaacctgagagtcctgtaacttcagttcttgctcactgccctgtgcatatggccttagaatcctaggatcctctttctgactttacagagatcacctccaagcctatatcgaattcctttcctgatcaatatataatgtgttcttagttcagggggccttcacaaaccagggcaacccaaaggtgctcagctcctacgctcttggaagtagcaaggtggggctcctcttcatcttgtaagtaaggaaacagtggcccaggatcagttcaatggcttgcccacgggcatatacctggctaattgcagaaggggaaggagatgcaggccttctgatccactctccaaatctctgttagttagacaaagagatcccagctgaaatatttggaatgctatttttactgaagctttgctttcccccagatttagtctcttttactgcctttttctcaaaacatatttaaactgcttggaaatgccaattaggggtctaaaatagaatgataactgcaccgatcaattggggaagctcactggttacccacaaaaccatcacagaccgcctattatgctgtggctaaaactcggatccatgccttcccgcagcctcatatggcagagcaccccagtccctcctgtcgttgccccatgttggccttgatgtctgcctctgaaatccttgattaccaacgtcaacaggcaattggccagcttaggaggggccttccaaggctatggcaagatagaagaatgacagtacagctcatcataaacgtatttatcaggcaaacttcaggaaaaactggtttctcaggcttgccacctgaagcaaaatagttctgggtgaagcttgacatggtgtatatctgtgggtcaggtcagcacacacacagaaaaagaatcttttttgttttctctttggagattatccaaactataaagttaaccagagaaatgaattatctgttttagtcaagcctatatttctttccaatggtcattttctggaaatgcaggaattcaagtttagaacttctaagtgatagagtcatatactcataaaatagtagcactgtatgggacccggaaattgtctaatctagcgtctaattttgcagataagaaagctgaagtttcccattattaaatgaatattgtacttccatgcaggcagagattgcactcatttctttacaagctgaaattacactgttggctcccatggcactggcagccagcctaaataaaacccataatatttttcatataaactgctcagctagattttccgcattccaggtttatacataaatttcttaacattttgttcaggagtttacattttccctttctaattttactagtttaaactctatatgccagtctatgatttgaattctggcccggtcttaagccttataagtacttgagaaagggcaagatcatttgctagtgtgcactttacagtgtacctgtctttatttatttttgtatttatttacttatttattatgttttgagacaaggtctcactgtatcacccaggctggagtgcagtggcaccatcatggctcactgtagcctcaacctcctgggctcaagcaatcctcctgcctcaccctcccaggtagctgggaccacaggcacatgccaccatgcatgtagaaaaatttaaatatttctaaaatgttgcccaggctggtctgaaactcctgggctcaggtgatcctcccacctcagcctctctcccaaagtgctggcatgacaggcatgagccacagtgcccggctcccctacaacttcacttcttgctcactgccctgtgtgtatgcccttacagtcctaggatcctccttctgactttacagagatcacttccaagtctatatccaattcctttcctgatcaatatataacatgttcttaggtcagggggcctccacaaagcaggacaacccaaaggtgctcctgcacttagctattaggacaatagctaagttgtcctaaataaaatgctatttatgaaaagcatttaacttaggtttcccccacctagttttgtcctaatttaattcctcaaggaggtttggtaacttttcctcccttcttacatgaaggagctctaaaaggggtctttcctctataagggagaagaaactttcgtagcttgtctcctaccagaagtagaagtgactggagtaatgtggtaaaaggctaccctctaaactccagagtcagaagaaccctttcttttttttttttttttgagacacagccttgctatgaggcccagtctggagtgcaatgatgctatctcggcactcactgcaacctctgcctcccaggttcaagcaattcttctgccccaggctcctgagtagctgggactacaggcacacaccaccaggcccagctaatttttttgtatttttagtagagatagggtttcaccatattggccagactggtctcaaactcatgacctcaagtgatccacctgcctcggctttccaaagtgctgggaatacaggtgtgacccaccacgcccagccaagaatcctttcttatgtccatgttgatgtataggttagtagtttatcttccatcagttatgaaaactgcaggagtcaagaaatttaggagtagggaggaaagaaaggaaagatttcctaatctcttcatactcaaaaggatatgtgctatatgaaaaaggagaattgagtgaaatatctgtgattactttatatattgtaagtagcctagaaacctaagaattatacctgacttcttccttcccttcaccccccatatctaataacaagaatcactaacacttatcaagtacttactgtgtgccaggtactgtgctgagcattttataagcctgattaattgaatcctcaaaacaattaggattttaagatgagaagattggcacttttaagaggttacattacttgcttgaactcatatatcaaagattgatggagccagattaccacccaaattattgtgactccagagcccaaaagcttacccacaataaatattgtcctctaggagagccatcagaccatgatacaggtttgtcccttatgagacatagaaggaagaatgaaaggaagttcaagagggagaaagatgctgggtagaaggaaggacaaaggaaggttggtgggttgtgcggcaggaaggttaggtggagggttggtgggttgtgtggaaggaaggttaggtggagggttggtgggttgtgcggcaggaaggttaggtggagggttggtgggttgtggggaaggaaggttacctggagggttggtgggttgtgtggaaggaaggttaggaggaaggttggtgggtttcgtggaaggaaggttaggaggaaggttagtgggttgtgcggaaggaaggttaggtggagggttggtgggttgtgtggaaggttggtgggttgtgtggaaggaagtttaggaggaaggttggtgggttgtgtggaaggaaggttagctggaaggttggtgggttgtgtggaaagaaagttaggtggagggttggtgggttgtgcagaaggaaggttaggtggagggttggtgggttgtgcggcaggaaggttaggtggagggttggtgggttgtggggaaggaaggttaggtggaaggttggtgggttgtgtggaaggaagcttaggtggagggttggtgggttgtgtggaaggttggtgggttgtgtggaaggaaggttaggaggaaggttggtgggttatgtggaaggaaggttaggagaaaggttggtgggttgtgcagaaggaaggttaggtggagggttggtgggttgtgtggaaggttggtgggttgtgtggaaggaaggttaggaggaaggttggtgggttgtgtgaaaggaaggttaggtggaacgttggtgggttgtgtgggaggaaggttaggaggaaggttggtgggttgtgcggaaggaaggttaggtggaggtttggtgggttgtgtggaaggttggtgggttgtgtggaaggaaggttaggaggaaggttggtgggttgtatggaaggaaggttaggaggaagattggtgggttgtgtggaaggaagtttggtggaaggttggtgggttgtgtggaaggaaggttaggaggaaggttggtgggttgtgtggaaggaaggttaggaggaaggttggtgggttgtgtggaaggaaggttaggtggagggttggtgggttgtgtggaaggaaggttaggtggagggttggtgggttgtgtggaaggaaggttaggtggagggttggtgggttgtgtggaaggaaggttaggtggagggttggtgggttgtgtggaaggaaggttaggtggagggttggtgggttgtgtggaaggaagtttgggtggaggaatcttagactgctgtgcagtattaagaaagttcagcaaggacaatgtaacatcttggagctaaagttgcccattagaggggtcccacattccccaggaatgggcctgccttaatattcctgttgcactcagtcatggagtagccttcgagaagcatgagctgagcaggaagccgtgatggatttcagaatgtagaagttggggctgtaagtcaattatgaggtgcatttctttggtaacatcttacatcacactgtcttttcaagcaaatcttttagctttgtcttcaacaaatgtctccacctactgccctagttcaagcctctgtcaccattcacctagacaattccaaaaaatgttttgtttccctacttctagtcctaatacccttacaatgatttcccacaatgctataaggatgaactttatgatacataaatgcaactgtgtcataattcggcttaagaatctaggtggatgccaggccgggtgactcacgcctgtagtcccagcactttgggaggccaaggtaggcagattgcctgagatcaggagttcaagaccagcctggctaacatggtgaaaccccatctctagtaaaaatacgaaaatggccgggtgcggtggctcatgcttgtaatcccagcactttgggaggccgaggcggatggatcacgaggtcaggagatcgagaccatcctggctaacacagtgaaaccccgtctctactaaaaatacaaaaaattagctgggcatggcggcatgcgcctgtagtcccagctacttgggaggctgaagcaggagaatggcgtgaacctgggaggcagagcttgcagtgagcggagatcgtgccactgcactccagcctgggcgacagagcaagaccccatctcaaaaaaaaaaaaaaattagctgggcatggtggcacacacctgtattcccagctactcaggaggctgagacaggagaatggcttcaacctgggaggaggagcttgcagtgagccaagatcacaccactgcactccagcctgggcaacagagtgaaattccatctcagaaaaaaagaagctaggtggagatgtctttttgtcaattgataatgggtacaatgatcctttagcatatatatgacaacaatctcaccagctttcattaacaaagctaatttcaaaattgcctcatattctttttggtaaggtcatcattatatttatatatggagctatcccagttaccatatgtcatttatctgcttaaaaacctacaaatatttactaggataacacctaagcttttgatcacagtaaactaggactcccaggacccagccactttctacttctcctgtattatccctgctactcctttcctggcatttaatactccaaaaatacagtaccaaactgtctgtagcttctgctgtgctgtacacatcatcttcatgtctttgtttatactattccctctactgggactgccattgtctcttttcctcctcccctcctttctgtgcctatttgaatgtcattttagattcagctcagctaccaccagctttccaagactccaatacaccaactcaaagatcatttagtccaagctctgtcccaattcaggaatcctatggaaaccgttcaggcagaaggtaatccaaggaagagctcacagtatcacaaggcaactagctgtatctttggactgtgctcatggtcacataaagcaatgacagccacttcccattgtgttttatcagggagtctatcagttcctgtttctccatcttttctgggtgcagtggttagaataatatactcacttgaagctttaagatgaacggagagttagaagttgggaggctgactgagaaattctcttggcaaatcctatagaggtggaccaagtgtggtggctcacacatgtaatcccagcactttgggaggctgaggtaggtagattgcatgaggtcaggagtttgagaccagcctggccaacaatggtgaaacctcgtctctactaaaaaaaataaaaataaaaaaataaaaaattagctgggtatggtggcgcgtgcctgtaatcccagctacttgggaggctgaggcacaagagtcacttgaaactgggaggcagaggttgcagtgagtgcagatcgcaccactgcactccagccagggcaatagactgaggctctgtctcaaaagaaaagaaaagaaatcctatagaggtgatctcctgctttgaaccttcagatcttgggtggggacagaagtggggaaggtgaggatgaggaaggacagagcttgtcaacaagccattggtcatgtccttctgcttgtaatgtctgaactttctagcttttcatttctaaattccctgcctatgactcacagatgtttcaaggggccttcagaatgcctgtggactttagtaggtgagagccatgggcagaggaaagatgtagtagatgacaaatcacgtgagggttagaatttggccacggtgactgcagttgctaagattctaaatgtttccttagtgctttttggtaaatctctcttctcccaagatcgaaaagttgcatctagaactagatatatagatggaagttacctaatatggaggaaaaaatagtgaacaaaggctaatttgggaatcctaaactcaattgggattgtggaatgaaaagcatgatgaatatgagttttctttatccacatctaaagcaagcatcattttcccaattttgagtaggtactgcctgcttttatgcattttagagggttcagtgtggtggccgagtaagcactgggacactgtcaagtagtttcagtcaaaagttcattttggggaagcataaaaaggactcgtaatatgtatgaaaaaataagtaaaataaatatgaataattatgaataaaaatttcaccactagcaatgttattcacgctgcaatcatggaaataaaaacaacaataaaaaatactgagcattaagaatcactaaattatcttaccagccatcatgactctgtacaaacagagcatacaattaaatttttcactggaacttgagtattgatcatctgggaatataaacatgagagaaagataataaaaggaaactagtggctgcagcggctcacgcctgtaatcccagcactttgggaagcagagctgggaggatcacttgatcccagcctgggcaacatagagagaccctgtgtctctttaaaaaaaaaaaaaaaaggaaattagtttcattgtattttaaaatttgttctaaagctacattaattgaaacagttggaggccgggcacagtggttcacgcctgtaatcccagcactttgggaggccaaggcgggcggatcatgaggtcgggagatcgagaccatcctggccaacatggtgaaaccccgtctctactaaaactacaaaaaattagccgggcgtggtggcgggcacctgtagtcccagctactcgggaggctgaggcaggacaatggcgtgaacccgggaggcggagcttgcagtgagctgagaccgcaccactgcactccagcctgggcgacagagcgagactctgtcaaaaaaaaaaaaaaaaaaaagaaacagttggtatagtgcagaaatagacagatcaatggaaaaagctcaaaagtggacccacatgcaaacaaaattagtttacaataaaaggagcattccaaatcagtaggaaaaatattcaataaatgttgttggtataagtgattagtcttttagaaaaaatgaaaatgcatccatatttttctctgcacatcaaaaataaatcccagaactaagacttaaatataaaaatgaaaaaaccaaagtactagaataaaataatgaatttttaaataatcttgcatggagaaggctttttcttagtatgaaaacttggcaatatttgtctataaaatccagaagttgtcataaagaaaagattaataaatatgactacttaaaaatgaaaacttctgaataaaaaaatacaatcaacaaagtcaaagacaattgacaatctgggagaaaagtgggcaacacgtattatctatatatgttctcattcctttagtatagatgaagcctttagaaatctgtaaggtaggctgggtgcagtgggtcatgcctggggtaattccagcactgagggaggccaaggcaggcgaatcaacttgaggtctggggttcaagaccagcctggccaacatggtgaaacctggtctctattaaaaatacaaaaagtagtcaggcgtggtgatggcacacacctgtaatcccagctaccctggtggccaaggcatgagaatcacttgagcctgggaggcagaggttgcaatgagccaagatcatgccactgcactcctgcctgggccacagagctagactctgtctgaaaaaaaaaagaaagaaatctgtaaggtaaagccaaccacctataaaagaatgagcaaaggaggccggacacggtggctcatgcctgtaatcccagcactttgggaggctgaggcgggtggatcacctgagtcaagagttcaagaccagtctggccaacatggagaaacaccgttagagactaaaaacacaaaattagctgggcgtggtggtgcatgcctgtaatcccagctacttgggaggctgagggaggagaatcacctgaacctgggaggcggaggtcgcggtgaggtgagatcgtgccattgcactccagcctgggcaacaaaagctggaaactccatttcagaaaaaaagaatgagcagaggacatgaactggtacttctcagaaaaagaaatatgaatgcacccaatgcacacataaaaagaatactcaacttcgctgctaattcaaataatgcaaattaaaatagcagtaagatggcaatttttaaccagtcaaattggcaaagctttaaaagtttaataacaaaacatgttggctggcaagcagggaaacacattaccaatggaagtatacgtatttataatgcttttggagaaaatttggcaatatttcttttaaggaaatttccttttaattctcagcaaggcaagttacttctatacagaagcgtgtgcccttacagatggaacaatgaggactgcacatctggacaagggaggggaaggggttcttatcccagaagcacttggcccctgctgctgtgtcgttcccctattggctagggttagactgcacaggctaaactaattccgattggctaatttaaagagaatgatggggtgagtgctttggcgggagtcagggcagagcaggtagcaggtaattggaatgagttagggtggagcaggtgatcagaatgagttagggtggagcaggtgatcagaatgagtggagagaatgagttagggtggagcaggtgatcagaatgagtggagagaatgagttagggtggagcaggtgatcagactgagtgaagagaatgagttagggtggagcaggtgatcagaatgagttagggtggagcaggtgatcagaatgagttagggtggagtaggtgatcagaatgagttagggtggagcaggtgatcagaatgagttagggtggagtaggtgatcagaatgagttaggatggagcaggtgatcagaatgagttagggtggagcaggtgatcagaatgagttagggtggagcaggtgatcagaatgagttagggtggagtaggtaatcgaaaaaggttgctttacgaggaagtttagtttaaaagtagaaggcaaagaattgaacatactgcctttttgtctctgtctcttcctctctctctctgcctctctttctctctctctttgactccttctttttctgtctcttcctttccctcactgcctctctgcctctcctctctctcctctagggtagggacttgcacgagtggagctactctctcttcccctgagaaggaaggaaagggggtggggttgtgtcaggttcaatccttgaaattagtggaaggcccaacccctcaacactagggatgtctcgccttgaaatttggcaatatttctaaaaaattcaagtgcaacatatacaccacggaatactatgcagccataaaaaaggatgagttcatgtcctttgtagggacatgaatgaagctggaaaccatcattctgaacaaactatctcaaggacagaaagccaaacactgaatgttttcactcataggtgggaactgaacaatgaaaacacttggacacaggatggggaacatcacacactggggcctgtcatggggtagggggaggggagagggatagtgttaggagatatacctaatgtaaatgacgagttaatgggtgcagcacaccaacatggcacatgtatacatatgtaacaaacctgcacgttgtgcacacgtcccctagaacttaaagtataataaaaaaaattcaagtgcaaatacttttaatctagaggttcctcttctaggaatctgttctacatataaattcacacaagaacagaaatatgtataataaaggttgtatatttctgcattaaccagtaaaaataaaaagtaaaacaaagtaaattatgaaaggaaggaaagaaaagcaacaatgaaggatgaaaatagtgctctatactgtgatatggaataatgtccaacatatagttaattgaaaaaatgtagaacagtgtgcatgatataataccatttgtataaaaatgaaacggagatacctatactccttgtagtgcatagaaactttttagaaggatatacagtggttaactctggagcgtgcatcagagagatggggaaaatgtttttattttttatcttatggcctttttttattgtttggatgttttaccgtggccatgtattacttttgaaataagctacatttttaatttttgcaaatgaaaaagataattccatctggttcaggaaaagtgtctgtagagaacatggaaggtgtttttttcattttgccacctttctttttttgagagggtcttactctgtcacccaggctggagtgcagtggtgctgttatagctcactgcagccttgaacccctggtctcaagtgattctcccacctcagcctcctgagtagctaggactacaggcatactctaccacagatggctaatttttaagttattttttaagagacagggttgctatgttacccagactggtctcgaaatcctaggctcaagcaaccctcctgtgttggcctcccaaagtgtagggattacaggcttgaaccactgtggccagcccacctttctttacttctcttttttttttttttttattgagacagagtctcactctgttacccaggctggagtgcagtggcacaatctcggctcactgcaatctccacttcccaggttcaagcccttctcctagctcagcctcccaagtagctgggattacaggcatgcaccaccacacccggctaattattttttattattttttatttttagtagagacggggtttcactatgttggccaggttgttctcgaactcctgacctcaagtgatccgcaccccctcagcctcccaaagtgatgggattacaggcacgagccaccatgcccaacagcccatgtttctcaaataatatttattcaactctattgagtaagtgataggagtctaaattcaatctcactgtttatcattctatttgcccatccatcagttcttggtaatatgtgttaataggcatggcctgggaaaacgaagtgcactgagaatttttagtctaactgctgtgtgtccattacaggtatcactcatcttgcaaaatggatattgttcagcaaaattaaaaggcttctctagagtaaaatccatgtcttactaacatttcagaagttaatgttctttcccagatacaatagattggattaaaattttgattgaagaagggattaagataatttctggaacatatattgggcattgccatgtagctgcactacgtatttatggggacatcccaagggttcctttgtcacttgttgcatgtatgtgacagaaagaatctggaaggcaatgaagtcaggacacttggcctgtgatcctccagtcccacctccatctgaccaagggtgagacacttttaaagagtttttgttcggtcatcagatatcgggaagtgttactatatggcaggcccttacactcagttatattcagttctgtatgccataccaccatatagtatatattatgagtatggtataatctagtgtaataaaatgttaataaataaataaaatagtaaaataagaggtatagagagctgccaactgcgtgtgaacaagccaagttctctcagatttgtcactctcctgcttaaaccttcagtagctccccagtaccttcaaattaagtccacatcctaagcttggcattcaaggtgcttcgtcatctatcacctgtccacttctttggcctcagctcttgacactgctctcatctcttgagatgcctgtgttacactcaaatctaattatttgcagttcccccccattatttcacagaactatgactttgcaaatgtttctttacctgcctgcttggaaaaacatgtactcagtgtttgagacctggctcagaaatcagcctttctgtaaaggcttgccctggttcctctctatattttctgaataactttattatcacacttaacaaactatattgaagttattcatttacattcttaaggaagtttggaaatgaaatgtaaaataaatccccattagtgtataagctccttgagggcagaggccctatctagttaatctttgtatttctagtatatagcacactgcctgctcaacacactttgtaaatgaatgcatagataaaagaatgaatttgttatactatagctgaaggatttctttgtagtttgacatttcttaatatagtgacaaatgcagtaaaacctgcatctctcctggattccatgttatctctacctctgccctacaggcactactcatagcattacagtgaagttcctgtaacaattcatttattttaaaacatactaaatcagcaagcatatatcatttatatcttgacagtgtactttaaagcagatgcttcagtttttcttccttcacatagctagcatctctccagacaagcttagatagcaacctgttttctttggcaaattgattaatggggacattactcatatgcctggttgcatgacatttccaataacattgtcattttgtttatggagtggtgggtaaaaatatccaggaatttactaccagtggaggaaccacctgtttgctggaaacattaaagaggaaaaactggagaggcagctctcttggagaatgctgaaaaaggtctaattccagcacgagcctgccccacaacaaaccacctcccaggggcacctgtggaaacaggagaacagccttgccgtgcatcttagcactttggctggggactgaactgccttgcggggacctggcaaaactgcagaggtagcttttctcatgcctgaagggtagcaaagggggttggggagagctgcccagcactgtgtcagtggcaaggagtggatttaggagtaggaaaaagggagaaaaccatgaatgagtggagggttcggaagtggcagggcgtggtggaggcacactggggagtaggcagggacccaactgtatgacagaaaattgggcaggtgtaatcagcctacaccttccacctcatctcaaagacctcacagcatagggggaggagtgggcgaccatgaagagaagttatgatctcgtcctctggaagccatgggcaggaaggttacaagcacgtatttgggcctcacctgcagcagcaagaacagagcaggtgaacaggcacgttccatgctgagtgggaaagggaaacacactgaaggcttgaagttttccgagacaaagcaaagccaactgcggaaacctttaagaattagggaaaggatgctcccccctcccaagaactttctgtcttaaaacacaaaacaacagaaataacagaacacaacacaagaaccacgtgctaaaaggagaagggggaagctgtggcggaggagctaagtccaggatgatgacccgggtgctgaacaccacgggaaaagatcaaggtttcttgtgcaatccttccctgcatttgcgtcagccagcacaaggccatcttgaattggcagcggtcaattcaagaagcttatgtgaaaggcagcattacttaagacaaaatgactttctatcctacttctggagaaatatctagaagccagggcttcaatgtaaagcaaatctataaaattcacaatgatatgtatgttctcctggcaaaatgtggaaggagggtgttgctactttcgtgttttgaatctcattattgcgagggcagcaggagtgtcaggagagcccgtagctctaaactctcaggactttaaaattcctatgctatgttataaaataatccctgtaacagaatagttatataaactcccagttctaataatactattttattggggaaacaaggtgtttgtctaaagagctaatttttgaaaattaaaggaacaaagagcttagtcatttgtgtgaaaaatatgtatatgccttcaccaagttcctgtagatcactgtggttatgtgtccaaaaggttccagcagaaggccccagaaaatgttgggcagcaccaagtccagaataggaatgaaaacagaatatttattttactcagattaaaaacaagccccaaacaggacgggcatggtggctcacgcctgtaatctcagcactttgggaggctgaggtaggtggatcacctgaggtcaggagttcgagaccagcctggccaacatagtgaagccccatctccaaacatacaaaaattagccgggcaaggtggcatgtgcctgtaatcccagctacttggaaggctgaggcaggagaattgtttgagcctgggaggtggaggttgcagtgagctgagatcgcgccactgcactccagcctgggtgacagagcgacactccatctccaaaacaacaacaacaaaaaacaagcaaacaaacaagcaaaactatcattcacacacaaacggaagagcttgcggaggcagctttggtgactgtctctggaaaggggtgatgatatcaggaactgttcagaaaaggccagtggaaaactttatgagggctaggtgtgaggaagcatcttttcggaacagtgcctttcacctcgactaggtaaaagctgagaaatagcatcatgtgagtctataaaaaccataaacagtaggcatagaatcagcatgggtttgcttatgaaataaggatgaaagagtactctgaaacttttttgaaataagcttagaatacatttttaaaggactatttcatggagcaagcaaaaaaagtatctttcttttctttttttaaataattttattttctttctatttttaaaaatcttatagccttcagtttcatctccaaaaaaaattttttttttttttgagacagggtctcactctgtcacccaggctgtagtgcagtggcataatctcgactcactaaaacctctgcctttcaggctcaagcgatcatcccacctcagcctccggagtagctgggactataggtacgtgccaccaggcctggttaattttttctattaaaaaaaaatcttggccaggcgtggtggctcacacctgtaatcccagcactttgggaagctgaggctggtggatcatgaggtcaggagtttgagaccagcctggccaagatggtgaaaccccatctctactaaaaatacgaaaaaaaaattagccaagcatagtggcgggcgcctgtaatcccagctactcgggaggctgaggcaggagaatctcttgaacctgggaggcggaggttgcagtgagtggacatcacaccacttgcactccagcctaggtgacagagtgtgagactctgcctcaaaaaaaaaaaaaaaaaaaagtctttaccggcagcctgaggtgagaggatcacttgaaggccaggaagtggagaccagcctgggcaacatggtgagattccattacccaacccccacctcctctacaatttttttttttttttaatgctgggcatattagcccatctacttgggagactgaggcagaaggatcactgaggaacactgaagcccaagagtttgaggttacagtaaactatgattgtgccactgcactccagcctggacacatatatgcataacagagccaaaagtggctactaagcaaaatttatcaaacttttagggatggctgagcgcagtggctcatgcctgtaatcccagcactttgggaggccaaggcgggtggataacctgaggttgggagttcaagaccagcctgaccaacatggagaaaccccgtctctactaaaaatacaaaattagccaggcatggtgactcatgcctgtaatcctagctactcgggaggctcaggcagaacaattgcttgaacctgggaggtagaggttgtgttgagccgagatgcaccattgcactccagcctgggcaacaaaagcgaaactccatctcaaaaaaaaaatgtatatatatatatataaaacattagctagaacaactatgccctctaacaaagaactgttgttggtgacagaaatagcatgttaggttagattctaagtgacaacaccttcattcctacaagagataatattcacatgaacatttttggaaaccattaactggtattatcactaaaaattttataatttatcacaaaatattaggtgctatgttgttcatgtaacattgaattaaccaaagaatgacattaactaccttcagatttaaacaaatgttttggagaacaattctttgtacaagcagaaagatttaaagataaagcctacgatggaaatctttctatacagatgaaggaagccttttaaaattaaaggaggctgggcgcggtggctcacgcctgtaacccaacattttgggaggccaaggggggcagatcacctgaggttaagagttcaagaccagtctgtccaacatggcaaaaccctgtttctactaaaaatacagaaattagctgggcatggtggtgggcgcctgtatacttgatcttagccaaaggccgagaagcaataagggcgcctgtaatctctgctactcgggaggctgaggcaggagaatcgtttgaacccgggaggtgggggttgcagtgagccgagatcacaccactgtactccagcctgggcaacagagtgagactctgtctcaaaaaaaaaaaaaaaaaaaaaaaaaaaagtcaaaggaattgaaaatatgcttttatgctttaaaatatgtagattatataagtcaaaaaataaatatgtgtgactactatatgatcccaaacagaaaaatcagaatatccatagtattataaaataagccaaaagaaagagatatttacatctagcaatagacagtatataacttagagtcaagaaatgttgggccaggcgcggtggctcacgcctgtaatcccagcactttgggaggctgaggtgggtggatcacctgaggtcaggagttcaagaccaacctggctggccaacatggcgaaaccctgtctctactaaaaatacaaaaattagccaggtgtggtggcacacaccggtaatcccagctactcaggaggctgaggcaggagaatcgcttgaaccagggaggcagaggttgcagtgagctgagaccgtgccactgtactctagcctgggggacagagcaagactctctatcaaaaaaaaaaaagaaaaagaaagaagaaaagaaatgttgttagcacttaaatccccataaatatttatggcttttcgaaaatatctttatggtcataagtaggtttgatagcatttcaatagtaaatttccttgtatttttttcttagaaatggggaagattgaagcaaaaaatggaacagttaaggctatttatgaagtaagaaatggttcccctgctactcttgtgaagtttccaggtaccaaaagcaaacttcctcctaacgactcagggttccaatcttttctcccttaaaaatacaagatccagaagaggagccctgtcagatttccattcaacaaaaccgctgggcttaccaaccttacactggaaacaacaagctcaaaagtggactctgaaacttgctttttaaaaaaagcgtttcaagcgataagtgtaacgtgctacagcaagtttagacatctgcaggtctgatgcagtcatctcctgagggtttacccaacagacacacacagggccaggcaccttttcttctttagcagcagaagaaaaatgtgctctttattgccaaaaataaacactttttaaaagacgacttctgttcctcaataaatatcccttcctttctatagtggatctctggttttctccaggctgcctaattaactgctttgggtgtgttcctaactggagacagtgctgaggggtcagggccacagccttcattaaggagaaatgaaatactcctcctgtgtacgtaggaggtgcccttggtcccgccggccgctgccaccaccaccaaactaaatgatcaggctcttggtggtgaaggggttcataaatgctgggtagagaaaggaatattaggtttattggcagggaggggacagccagggtctaatgctattctcagaaggttactctcaaattagggacacctgggaatttgaagtgttagtggccctggggaaaggactggaaggatttataagccccttgaatgaacgccgtggcactcaatcttaacaccagaaatctaaggtacaactgaaaattactccttttggacagaaaggaacagaagggagaattggttttattttttcgggttgtttgttttttgtttttttttgagacggagtctcgctctgtcgcccaggctggagtgcagtggcgcaatctcggctcactgccagatctgcctcctgggttcatgccattctcctgcctcagcctcccaagtagctgggactacaggcggccgtcaccacgcccagctaattttttgtatttttagtagagacggggtttcaccgtgttagccaggatggtctccatctcctgacctcgtgatccgcccgtctcagcctcccaaagtgctgggattacaggggtgagccaccgtggctggccgagaattgttaaagaaggtactggactatactttctcagctctctcctacctccccgaccctaacccccatgggtatccagtttctacttgctgctcttcaaatgctgaaagcccaaccacagcaatcagatctactcagatcttccccctcttataacatccatcctccaaaaccatatattcctcttttctcccccatgtaaaccctgtgttaaattaatatttagggagcaggtaagagaaaaagaagcatatccatactaaagtgtaaatgactaatagggatgcttggaaagccctctcttacaaagggttgctcagttttaaacagttgcttattggccaaataaatacattttctattatttcctcaaataagggcgcattttattctttctcactgggcgagggacgtatatggcttagaaacagcaacagtaggccaggcacggtggcctgtaattccagcactttgggaggccaaggcaggtggatcacctgaggtcgggagtttgagaccaggttggccaacatggtgaaagcccgtctctactaaaagtacaaaaattagctgggtgtggtgacacattgtaatcccagctactcgggaggctgaggcaggagaatcgcttgaacctgggaggcagaggttgcagtgagtcgagatcacaccactgcactccagcctgggcgacagagtgaagactccatctcaaaaaaaaaaaaaaagaaagaaagaaacaacaacagtattttaagcagaaaagagtaaatagtacagtatcaagaactactggtgttgcatttgaagggaagcttttagtatgttggtgaaggggaagaggtgagggaaagtttgagcttggaaggttttagttccttgagcttcattttctcttccttatttttatgctgattgggtctctttttccttgtcaacagactgcttcagtacttcttggctttatttatttattttgctcctgctaacaagctggaggctgagttatgtgctcagtctgaaaatgttccttttgactgttgtctctgaactttctaaccaatacagagagtaaataggtactgtgctgtatgcaaatgtaggcatatttgtccgtgtaggccaaaggaggggaggcatgttgcaaaatgcctttagaacaaaaacaaacgtttccaatagagtattttatagccttttgaaaataagctaaacttttagaaaacgaaaagtacagaggaagacttatctataaaataaattggaaaaaaccacacacaaaacaaaacatgactaatacttcgacagtgagttcacctcaagcatttcatgaatttcacatgacccacccactttttctctgtacctctgaggattaccatattagcagcaataattactcttttgttcaagtgccagatttacatatcaacgtagccatggcattcctgaatgtagaatattgtactgttcgcctcgtttgtggtttctataataaggttaatttttgttcccttaccctcctcacttaatctcatgccaccccctacctttcttcaattagtggtttgttttttactttgaatagtttttctcctttcctttctcagtctctgtgtcatgatttgaactatcctcaaattcactgtacgaaccatgctgcatttaaaactttttatcacccagccatggatgatcaattctttgaaaagacaagccaaagacagagaagttatgaatgggcatttctaggatgactctagaataccttcttccccaagtttaggatgtgtggtaagatgcgtcagaagttaccatggtagatttcatggccatctttgtcttttttttttttttgagatggagtctcgctctgtcacccaggctggagtgcagtagtgcaatctcggctcactgcaagctctgcctcctgggttcacgccattctcctgcctcagcctcccgagtagctgggactacaggggactgccaccatgcctggctaattttttgtatttttagtagagatggggttcaccgtgttagccaggatggtctcgatctcctgacctcgtgatctgcctgcctcagcctcccaaagtgctgggattacaggcgtgagccaccacacccggcccatctttgtcttttccttggtaggcctttaaaaaaaattattgctatttctagattttattggagatggatctagcaaaaatttccagaattgcatcagacatttttaatttccaatggatgtttggaaagggttggacagttttaaaatttttcagactcaaacatgtcaaactggccaggtgcagtggctcacacctgtaatcccaacactttgggaggccaaggtgggccgatcacctgaggtcaggagattgagaccatcctggccaacatggtgaaaccctgtccctactaaaaatacaaaaattagctgggcatgctggcacatgcctataatcccagctacttgggagtctgaggtaggaggattgcttgaacccgggaggcagaggttgcagtgagctgagatcatgccactgcactccatcctggcaacagagctagactccacctcaaaaaagaaaaaaaaaagtgtcaaactaaatggaaagccagcttgggcctaacaagctattttaatgagcattctttctctgtgatgttccccaggggatatgagcccaagaagacccatgtggcccagggagtaacatgatcatcttggctctgtttagacacctgtgcccagcggtaaggggaccaggaggcagacagatagatgagggcatggaggcatgcagacccattaggagtgggtgtgcaccatgctacttagaaagttactacaagaaactccatagcagtgacagaggcttgatgcaacataggccaacagtgcctctatgtggggtgtctgagagtatatgaaatgtgtttgtgactgttggggagggagtgaagagaggagaaatgtatgtgttttttaaaggaattgcatgccttggaggttccttttgagaagatgatataggaaaaaaagattgagaaccgtagatatagaacacatccaggatgctgagagcacattcttcccctaaccatttaaaaaacactttgctgtgtttgctcttctaatcagtctgatgcgcagctttccctgcccaccataagttttacatcctcttaccttcaacttatcaccacatagatattaaacttgatctgtattattttttaccagatgctttgtttagtgaatggtctaagttttctgtatgtcacctcctggattataaagtccttgaggatttacactgtaattttagaagttaatacacctactaggtgcagtggctcatgcctgtaattccagcactttgggaggccgaggcgggcggatcacgaggtcaggagatagagaccatcctagataacacggtgaaacccagtctgtactaaaaatacaaaaattagctgggcgtggtggtgggcgcctgtagtcccagctactcgggaggctgaggcaggagaatggcatgaacctgggaggcagaggctgtaatgagccgagattgcaccactgcactccagcctgggtgacagagcgaaactctgtctcaaaaaaaaaaaaaaaagttgcatgggacacactttcctaaaagagtatttgcggtttatctgaaattcgaatgtaattgagtattctgtgtctatattgctaaatctgagaactctacctcagttggattttgcaagggttgagaaagcactttgtgagtctttgaaaaggtgtgagccaaagggctcttcaggagcagcattgacaaatatgcaatctttgtcaagttctcaaaggcccgaggtaggccaaaacaaaaacaacagtaaaaacaagctcactgactttattaaatgaggacacagccagttatttttaaaataactttattgagatataatccactcatttaaagtggtttaactacagttaaactacaatttagtggtttttaatatattcacaggatgtgcaaccatcaccaaaatcaattttagataattttcttttcttctttttttttttttttttttttgagtcggagtttcgctcttgttgctcaggctggagtgcaatggcacggtctcaactcactgcaacctccgcctcctgggtttaagccattctcctgcctcagcctcccacgtagctgggattacaggtatgctctcccaggcctggccaactttgtatttttagtagagatgggtttctccatgttggtcaggctggtctcgaactcctgacctcaggtgatcagcccacctcggcctcccaaagtgctgggattacaggcgtgagccaccatgcccggctgaattttagatcattttcatcacctcaaaaagaaacccagtactcattaaccgtcactctcctttccaggatccctccatccctgccattcttcaaccctagcccttggcaaccactaatggattttttggtctatttagatgtgcctgttccagacacttcattataaatggaatcatacaatatgtggcctattgtgtctggcttttttcacttcacataaagttttcaaggttcagacatattgaagtgtgtatatcccttcattttttttcattgctgaataatatttctttcctttttttttgagacagagtcttgctctgttgcccaggctggagtgccgtgatcacagctcacttcagcctccaactccagggctcaaacgatcctcccacctgggcctcccgagtggctaggactacaagcaccaccaccacacccaagtaatttttaaattttttgtaacacacccaactaatttttaattttttttgtagagactgcatcttactatatgggtcttcttccttcttctttcttcttccttcttctccttcttcttccttcatcgttcttcttccttctttcattcttcttcttcttttttttttttttaaatacagtgtctggctctgtcgcccaggctggagtgcagtggtacaatcttggcttattgcagcctctgcctcccaggcccaagtgatcctctcatgtcagcctccccagtaactgggattacaggcatgtgccaccacactcgactaatttttgtatttttttgtagagacaggttttgctatgttgcccaggctggtctcgaactcttgggctaaagcaatcctcccgcctcggcctcccaacgtgctgggattacaggcgtgacccaccacccctggccagtatttcttaatttgtatagtccacactggtttatccattcatccagtaaaggacatttgcgttgtttccactttttgactattatgaataatgctgctaggaaagaacatttatatacaagtttttgtgtagtcactcgttttaatttctcttgggtatgggagtggccaatattctgaagaactgccaaatttcttcccaaagtagctgcactattttacatacttagtttttgtttttcgtttttttttaaataaagaacctttagggtttcctcagcgtcccagaggagggcctgcttccggcaccccgccttcagggctgcctccgcagagcaccaaactcccgtccccgccattccaggccctggcacttaggagccaaaacctcaggtcaggcgcactttgggcctccagcccagccccgcctcctcagcgctagctagtaggcaaaaggaaaacagctgccccttaatgaggctatgtggacatcgtagttttttttccagtcagtagcgcagagactgtgataagaaaaatcacaattcccagaatgccgcggtgctacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaatttttttttttttttgctttgaatatttctttggggaggggacatcacacttctttcttttttcttttttttcttttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggggtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttccagttttgccatagtaagatttgtagggcattagttttttttttttttttttgagatggagtctctctctgtcccccaggctggagtgcagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatattaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaagttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagataagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggaatggtgatgactcttaacgagcatgctgccttcaagcatctgtttaacaaagcacatcttgcactgcccttaatccatttaaccctgagtggacacagcacatgtttcagagagcacggggttgggggtaaggttacagattaacagcatcccaaggcagaagaattcttcttagtacagaacaaaatggagtctcctatgtctacttcgttctacacagacacagtaacaatctgatctctttcttttccccacatttcccccttttctattcgacaaaactgccatcgtcatcatggcccattctcaatgagctgttgggtacacctcccagacggggcggctgccgggcggagacgctcctcacttcccagacggggcggctgccgggcggagacgctcctcacttcccagacggggcggctgccgggcggaggggctcctcacttctcagacggggcagccgggcagagatgctccttacctcctagacggggtggcggtggggcagagacactcctcagatcccagatggggtcatggtggggcagaggtgctcctcacatcccagatggggtggcggggcagaggcgctccccacatctcagacgttgggcggccgggcagagacgctcctcacttcctagacgggatggcggccgggaagaggcgctcctcacttcccagactgggcggccgggcagaggggctcctcacatcccagacgatgggcagccaggcagagacgctcctcacttcccaggcggggtggcggccgggcagaggctgcagtctcggcactttgggaggccaaggcaggcggctgggaggtggaggttgtagcgagccgagatcgcgccactgcactccagcctgggcaacattgagcactgagtgagcgagactccacctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaactccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgcttgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcacaccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctgttttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaagaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatgtgaactttaggattagcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagaagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgatcacttgttaaagagagaaaggaaattactaacatttatttctttattttgggagtagaaataatactgtgacaattattaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcacctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattattatttttttttattttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacattatgcctgtgtttgactattgttagcatttaagtcactaaagatcaatatatttaatgagttggactctaaatatgtggtactgtaggtatcacatttcccaagtctttttagctatatcatgtctatcttcggaatggtatagtcgggggccctttttatcaataatagccttctattaattagactaattttaagaacaactaatacttcaactggcaatatcatcctataattatccacataaagtagtctttcaggctgctaggtaacttggctgtcttctattccatccgttttatttaactacacgatggtcatgaatcagtggcaggactgccttgtaaagttgtgctgattttgcactgcacaaaagtacatagttaaggaggcgaatggactttaaaatctagttcacattcccctcaacaagctacgtgtggaggaaggggctcttgccttctcaccaaggtgtacatgtggcacaggtctccccagaagaggtgtctttttctaatttgcccaaaggggatacctgtcttaatacatccaccagggggtgcctttttaaaaatgtgcaaagccgtggtgtgttgcagctggcttttgctggctccccagaggagaaccaattgtgtgcatctcttcccaacttgatgttcagtgacatcaggttggtagcttttaatggacaatggtaggagtatttgtatcatagaagttagtaaatgctgcaaattgtggatcccccaccccctcagtcagtttctaacacaccactgaaaaaggcccgatgtaggctagcattgcatttcccagagcaggcacactggagtcctaaaatgtgtatgattaaaggacacatagacctggaagaactctttttataaagctgtaggcagcttggagttgtccgtatcaaattcagattggttcacagacatatggtagttctgactcagaaactgttacgggtcacagaaaaatacacagtccaactctagaaatgactaggaagtgaatcagctgaattactatttttgagatggagtcttgctctgtcacccaggcgggagtgcagtggtgccatctcagctcactgcagcctccacctcccgggttcaagtgatgctcctgcctcagcctcctgggtatctgggattacaggcatgcgcccccacgcccagttaattttttgtatttttagtagggatggagtttcaccattgctggacaggctggtcttgaactcctcacatcaggtaatctgcctgccttggcctcccaaagtgctgggattacaggagtgagctaccacgcccagccgaatcagctgaattcttaagccttagcataaaagcaggcacaactaatacacctactgtgttgtgatacagttcaccagacactcctggattgaggagggctggagctggacagtgaactctggcttacaggccattttgactttgcagtaagataaatatttgggcaggaaaattttcccatgatccaacagatcccaatccaatcttactatgcctcggcaaccctttcctgagaaggacagcagtgcctggcaagcacattataaacctgagtccaggtttatccccttgtgtaatcaagtccatgggctggatgtgacaacacatgtgcctaagctaggtaggcttgaatagtacagaatgaaataggccaaaaggctgtcccaagcccacactgagtttcagatcttacctcttaaatggaacagagaccatgcttgtcagcaccacaagaaaagtttgtacaagacttgtggcaataaatagatacctctaaacctgctcattctcaggccaggacaggcctcagctgccacaaaggaagagagagaatgttgaaaaagtaaggaagaaagaaaaccaaaagatggccaagccttctttcagaaggaggaagatagttcatatgggggctatattagtccattctctcattgctgtaaagaaataactggcagagcttgcagtgagccaagatcacaccactgcactccagcctgggcaacagagcaagactctgtctcaaaaaaaaaaaaaaaaaaaaaaaaaaaaaacaaaaactgagactgggtagtttataaagaaaagaggtttgattggctcacatgtggttctgcaggctgtacaggaagcatgactggggaggcctcaggaaacttacagtcatgatggaagacaaagtgagagcaggcatcttgcatggcagcattgggaccagggatcgggggtaccacacgcttttaaataaccggatcttgtgagcactcactatacagcaccaaagggggatggtgctaaaccattcatgggaactccaccctcatgatccagtcacctcccaccagtccccacctcccaacactggggattacattttgatatgagatttggtggggaccagatccaagccatatcattctgcccctggcccctccaaatctcatgtccttctcacattgcaaagtataatcatccccttctcagtagccccccgaagtctcaactaattccaatattagctcaaaagtccacagtccaaagtcttatctgagacaacacaagtcccttccacctatgagcctgtacagtcaaaaacaagttagttacttccaagatacaaaagaggtacaagtattgggtaaatactcccactccaaaagggagaaatcaaccaaaagaaaggggctacaggccctatgcaagtctgaaacccagctgggcagtcattaactcttaaagctccaaaatctcctttgacttcatgtctcacatccagggcacactggtgcaaggggtgggctcccaaagccttgggcagctctgcccctgcggttcagcctccatggatgccctcatgggctggtgttaagtgctagtggcttttctaggtgcatggtgcaagctgttggtggctctaccattccagggtatggaggatggtggctctcttctcacagctccaccaggcagtgccccagtggggactctctgtgggggctccaaccccacactttccctcctcagtaccctacatgagggctctgcccctacagcaggcttctgcctgcacatccaggcttttccatacatcttctgaaatctaggcagaggctcccaagtctcaactcttgcaccctgtgcacctgcaggcttaacaccatgtggaagctgccaaggcttatggcttgcaccctctgaagcaccagcttgagctgtatccagacacctttgagccatagctggaggtggagtggttgggatgcagggagcagagtcctgaggctattcagggcaacagggccctggacctggcccatggaaccattcaatcctcctaggcctctgggcctgtgatgggagaggctgtctcttagatctctgaaatgtcttgagggcttaacctcattgtcttgactatcagcaattggttgctttttactaagtaaatttctgcagtgggcttgaattcctgccctgaaaatgggctttgtttttataccacatggccaggctacaaatttcccaaacttttatgctttgcttcccttttaaatataagttccagttttatgtcatttctttgctcatgcacatgagcatatgctgttagaagcagccaggctaaatcttgaatgctttgctgcttagaaacttcttccgccagataccctaaatcatcattctcaagttcaaagttccacatatacctaaggcaggagcacaatgcctccgaattcattgctaaagcataggaaaagtgatctttgctccagttctcagttaagttcctcatctctgtctgagatgtcatcagcctggccatctctgttccatatcactatcagcattttggtcacaaccatttaacaagtctctaggaagttccaaaccttctcatctttctgtcttcttctgagccctccacactcttccaacatctgcctgttacccagtttcaaagctgcttccacattttcaggtatctttatagaaataccccacttctggtaccaattttctgtattagtctgttctcacattcctataaataaatacctgagactggataatatataaagaaaagaggttcaattggctcatggttccataggctgtatggaaagcatggcagcatctgcttttggggaagcctcaggaaaaagcaggagcaggtgtcttacatggcagaagcaggaccaaaggggtggggaagatgttacacactttttaaatcaaccagatcttgtgagaactcacactatacagtaccaaaggggggatggtgcaactctgccctcatgatccagtcacctcccaccagacatcacctccaacactggggattacaatttgacatgagatttggtggggacacagatccaaatcatatcaggagccaaagcaaagatgaaagctggcaatgcctgttttcttgttggagtaacctcacctttttgccactccagacaaaaaaagaaaaacccatgtgcccatgagccttttgaaccaggcagagtaagaaatctacctagcaataaccaataaaatgtctttaaagctgactgtagtgcaacagtcctcttcctgaaatagtggggagaagggagacttcagcacaaatcagaagaatacagactagtgtaagaaacaaaccataataaatctgggctcaggagatgataactcattttagatgatacaggggtaaccagctagatatatttgaagtaggaaattggggaagatggttccaaatacatgggactcatcacagggttcctttatttttatttattactattttcgaggcaaggtcttgctctgtcactcaggctggagtgcagtggcatgatctcggctcactgcaacctctgcctcctgggctcaggtgattctccaacctctgcctcccaagtagctgggactacaggtgtgtgccaccacacctggctacttttttctttttaatttctattatggatatgctgggaataactggctgattttttaaaaaaaatttttgtagagatattttgttatgttgcccaggctggtcttgaactcctggcctcaagcaatcctcctgcctcggcctcccaaagtgctgggatcacaggtgtgagctaccattcccagcttcctttaaatgaccacgcttagtgaaattaatgttttcagatcattaggcataccattatgtgactggaggtgacacaaaacatcaagctaaaatgtgcttatccatttgttattaggttagatgaaaacagaatggctctacaagtctgatatgtgccaatatcattttaagtaaacatgactttttaggagctttttttttttttagtaaaaaatgtaaccagttgtgtactgatagatgtttaacacctgacgcttggttgaggggaggcctaatttgtagtatttgccaatttctggggtggaaatattcccaccatagttggtttcaagctactgtgttcttaaccagctcccaaagtttttgaaaatttaggattggctcttgcaagtgtgtatgagccaattgtacatcatgggataacatatatggcataaagatgggatatcagttaggaatctcttggctgcaagtaaagaatacacaactaaaattgacaaataataaagacctatctcacataataagtctgaggactacagtggctcaacaatgtcattaaacagtttacaaatgtcatggcaaagtcaggaagttaccatatatgatctaaaaaggggaggcatgaatgatccaccccttatttagcatataatcaagaaataaccacaaaaatgggcaaccagcagcccttgggctgctctgtctatggagtagccattcttttattctttttttttcttattttgaggaagagtctcgctctgttgcccaggctggagtgcagtggcgcaatctcagctcactgcaacctctgcctcctgggttcaagtgattctcatgcctcagcctcccaagtagctgggattacaggtgcccgccaccatgcctagctaatttttgtatttttagtagagatggggtttcaccatgttggccaggctggtcttaaactcttgacctcaaggaatccatccgcctcggcctcccaaagtgctgggattacaagtgtgagccaccgtgcccagttcattcttttattctttaccttcctaataaacttgcttttacttaaaaaaaaaaatgacattaaaaacccagaatctttccttccttctgctccaccatcctctgcagattggctgtcaccctcagcttacccactcatggttgtaagacaactgctccaggcatcactctcacaaccatgatctaaggaggaaaaggagttttttcttgctactgttaatggtggagggtctccaggttcttgacgttttgaacaaagaattggacaaaacgcacaaacaaagcaaggaaagaatgaagggttttactgaaaatgaaagtacacttcacagtgtgggagcgggcctgtgcacaggggctcaaagactctgttaacagagtttttgtgagcttaaataccctctacttggggtacgacctatgtaaatgaagaggatgaagtaaagttacaaagtcatttactcagtgtatgccctatggagaggatatttcctgtcatagctgaaatgtgaatcagccttatgttccctgcctccagaccctatttttctgcctcactacttcatcttatcagggagaaaaacctttcccagatgccccctcaacagacttatctttacatctcattggccagaagtttgggctagatgaacaccaataagccattcactgataagagggaatggaattgccatgattggcttaaacacagttaatcccttaaaaccaactaaccttgacttcattgctacttcacacctgaacaaaatcagtgctgttggcaaggaagggagtggctgttaggaagtacaaccaacaatgtctaccacaacaaatgaatgcagttaactgtggaataaaccagagatcatcagtaaacaaatgactgagctttggtagaacttcctaaattccaatcaaggtgactttggtagactctcaagaaagcatacctaaatgtgatataatttattaagtacaaaccaattctgccctcttatgagaatatatgactagatggaggatgatcagaacaaagaaaatggaaatcaaaagagtcagaaggtggtagagtttattcagcactcttcagaaagagactatgaatatggcatacaaaagtctagttgtcaaagaggtacatgtaaatattgagctgagatggttcgttaggtcctttcatggcctgaatgaaataaatatatttcaaaaatacttcagtactatagaggctgattcttttttttttttttttttttttttctttttgagacagggtctggtctgttgcctaggctggagtggaaaggcatgatctcagctcactgcaacctttgcctcctaggctcaagtgatcctcccaccccagcctcccaagtagctgggactacaggcatgctccaccatacccagttaatttttttgtagagatggggtcttgccatgttgcccaggctggtctcaaactcctgggctcaagtgatctgcctgctttggcctcccaaagtgctgggattacaggcgtgatccacagtgagccactgtgcctggccagttcccatttgatttatttatttatttatttatttatttatttatttattcattcatttattgagatggagtctcgctctgtcacccagactggagtgcagtgatgctatctgggctcactgcaacctctacctcccaggttcaagtgattctcctgcctcagcctctcgagtagctgggattacaggtgtgcaccaccacacggctaattttttgtatttttagtaaagacagggtttcaccatattggccaggctgatctcgaactcctgacctcaggtgatctgcctgcctcggcctcccaaagtgctgggattacaaacgtgagccacgacacccggcccccattttaaattaaatacttctttcctttgacaaaattaattctagatgagcaaagatgtaaacattctacaaaaccaaaaccagtcaggcatggtggctcacgcctgttatcccagcacgttgggaggccgatgtgggcggatcacctgaggtcaggagtttgagaccagcctggccaacatggtgaaaccccatctctactaaaaaaatacaaaacttagccaggtgtggtggcacatgcctgtaatcccagctagtctactcaggaggctgaggcaggaaaatcactggaacctgggaggcaggggctgcagtaagctgagatcacaccactgcaccccagcctgggtgaccaagcgagactccatctcaaaaaacaaacaaacaaacaacaacaacaacaacaacaacaacaaactcaataacctttacctctagagagaggtactgggagacaagcctagggtaagagacagatttagttttcaccacatgtcattttgttggggcagacagcctctaaaatggcccccatttccccgcctctgatattcacacccttgcttggcccctccccttgagtatgggcaagagctataactcacttctgaccaacagaacacaggaaaggtgatggaatgtcacttccatgcttaggttacataagatagcaacttctgtcttgatagcagcccctctcgtttgatgctttatgaagcaagctgccatactggagaggcccatgtgcaaggagttgagggccaacaaccagcaagggactgaggcccttgatgaattgaattctgataacaactacatgagcttgaaagcagatcctatctcagttgagccttcagatgagaccccatcctggttgacaccttgattgcagccttgtgaatcagaagattcactgttaagcagttaaactgtgtccagatttctgacccactgaaactatgagatcatatatgtgtgtggttttaagctgccaaaaaaaaaaaaaagccccaaaacaaaacaaaacaagacaaattagctggacatggtggtgtgcaactgtagtcccagctattacatttggagggcagaggcaggaggatcatttgaacatgggaggttgaggctgcagggagctgagattgtgtcactgtactccagccagtctgggtgacaaagtgagaccctgtctccaaaaaataaacaaacaaaggctgcagcatcaaatcttgcctgctggcctgccccacagatttcaaccttgccagcagcacccataattgcatgaaccagttcctaagagtaactctccacccaaccatcatctatgcatatttcctgttggttccgtttctctggagaaccctaatatgggtaagttctgttatttcccccattttaatcatggagaaggcggggtctgagaacaatttgcttaaatagctggtaagcagaacctggacatggacccaaaaagtttggctccagagcccttgaaaataaccattatactattctgtaactaaggacaactgtgctggctgcctatctcactggagttttgtaccttttttttttttctgatttgtaaagggtcattcaagtgcagtgcatctgcttagagaaccagatagcatggaagtgaaatgacccttgactgatgagcagagacccatccgttcttctcagctgttgtgctgccatcctccccaccatgcaactcttcacagctactattttgttgtccagcggtctatgctatggtcttattgtccttcctgagcaagcatagtcagggtcctgctggccaaatgtacagtagtcttttaaaggagactgttctttggaagatactgcagggaaacagaatagagaggattcattcagaattcccctcaaggagtttgaatctatatctaggggttgtgggtaaataactggaactgccttcctgactgcctgctgggaaccagcctatgttcccagacctccagacctgcatcataatcctcaaaccagatacatgcgaactcctcactgcagagcccagcatttgttggaggtctttcttctgtggaactaaactcacacattcttcaaattattggtgaatccaaattgcataaccctacacatagaacttaattagggttcacagagagtctgtaaagcaattcttttaaagaagcttcttctggccaggccagtggctcacacctgtaatctcagcactttgggaggccaaagcaggaggatcattgaggccaggagttcaagactaccctgggcggcaaagcaagattccatctctactaaaaaataaaatatatatatatatttataaaagaggcttcttctgagaaagaaaatatagagctcttgaagtgttcaattgtccaaaaaagttcagaatggcccggattgtaggggcttactttaaaatacatttaactgcctgcttaccagcagcatatgaacattcacttgtagggaaactctagatacactgcgatgaaaaagtccatgaattctctgagtcaatgatgaaaagagcggaaaaggaaaagacaggccctggcaagtgtgggtggcactaatgccagcttggtggtctgatggagttttttgaaaatgatcacatttgtagaatgggtttaaaacaatattttgactagtgatttcatgtctgaaaagggtattattttggaatttcctccagtgtttaaatgctttgtgttttgaacacactgattgattacttaatctacagctgcttctgggtgctcagcaattttccctgtcttgttgctatgagacgaggacttccctgaattcgccagtgtgacaggcatcgtgaagaggtggtgggctctgcccacaagtcacagtgccatcaagcggtcattctggaaaactgttagaggaagtcggtttgtttccactgttctctaattatggcactctaaggtcatcattttcacagatgaattagcaggttaaatgaacagtgaaggcttatgtattcctttcatattctcctgcacacagtttggatttttaaaaatcgaatacatccagcccggccaacatggtgaaaccccgtctctactaaaaatacaaaaaaattagcagggcgtgttggcacggggcctgtaatcccagctactcaggaggctgaggcaggagaatcacttgaacctgggaggcgaaggttgcagtgagccaagatgagtgcagtggcagatctcagctgtaacctccgcctcctgggtagctgggactacaggcacacgcaccacacccggctaattgtagagatgaggggtctcactatgttgcccagactggtctcaagctcctgggctcaagcgatctgcctgcctggcctcccagagtgctgaggaataaataaaactaatgtattaaaaaataaatgaatcaggccgggcgctgtggctcacgcctgtaatcccagtactttgggaggccaaggtgggtggatcacgaggtcaggaattcaagaccagcctggccagtatggtgaagccccgtctctattaaaaatacaaaaaatagctgggtgtggtgacgcatgcctgtagtcccagctgcttgggaggctgaggcaggaggattgcttgaacccaggaggcggtggttgcagtgagctgagattgcaccactgcactccagcctgggcgacagagtgagactccatcttgaataataataaataaataaatatataaataaagccacagcaagccaaatggtaaagttgaaagaaagttgaggccaggcgcggtggctcacgcctgtaatcccagcactttgggaggccgaggcgggtggatcacgaggtcaggagatcgagaccatcctggctaacacggtgaaaccccgtctctactaaaataaaaaaaaaaaaatacaaaaaattagccgggcatgatggtgggcgcctgtagtcccagctactcaggaggctgaggcaggagaatggcgtgaatccgggaggcggagcttgcagtgagccgagatcgcgccactgcactccagcccgggggacagagggagactccgtctcaaaaaaaaaaaaaaaaaaaaaagaaagaaagaaagaaagaaagaaagtttaaccggtgggtaggggacattgcaggttagccctaacttcacatctcttggtctcaatttccgcttctaactaatgaagggcttggcctgggtctcccaacatcccttctgctctgaaagtgtctaattccttgcttcttttacatatggtttttagaggagcataacctggaagcggatcctggtcaggtctccccagctgagcctggttatgtgacttcagagtgagcttgtgcaaatggcagcaaagatggaagggcggaagagggtctgtgcccacagggggaggtgaaattgccagcactctctggcaaacgactccactccccacatgcttggtggagatgggcctccaccaaggacaaaattgtcattcctgagggagaagtctggcccggggtatcagctccgggcatgggggctaagcctgtgatgaaaggctcacaggcaagcgcatctgtgcaggatgtgcttattgactcagcagcaggctggacattaacgtattcgatgaagatgagaagaaagggagaattcagattccactcaaaggatgcatccctgtcccttccctcctcaccgacggtttacgagaacctggagccaggtaggagaactgcctctactgtggagcctgcttccaactgtttcctttcttgtactcctgtttgaagggccacatgattctgggtgtgtggtgcacctcattgtctccctgtggcttaattctggttcttgtggagtaaatgtgagatgtagtgaatgctgttcttgtgttgagggacttaagcaaattttcatccatctgtgcattatgtaaagcctcttccaaattcaggataagagaaacaccaggaatgctgaatattaagctaaacaaaaatacagtgaattaccaacaccctgagagaacatagctgaattaatacaggtcacacgactttggggctctcttgactgtgacttaatactcttaatttgtcattatttgggggattaaaaaataccttctggccgggatggtggctcgtgttgtaatcccagcactttgggatgctgaggcgggtggatcacttgaagccaggagtttgagaccagcctggccaacatgggaaaacactgtctctactaaaaatacaaaaattagttgggtgtgatggctgtaggcccagctgcttgggaggctaaggcatgagaattgcttgaacctgggagatggaggttgcagtgagctgagatcgtgccactgcaccgcagcctgggtgatagagcgagactctgtctcaaaaagaaaaaaaaaacaaactgtttacacaagagcttgtatcacattgtctcactgaatatccacctactgtagtaaactcccagaacgttagacacaatagagcttagaaatcacctagtgtaattcttttcagtttaaaccgagacctataaatatataaaaacaaaatggaaacaaattaaacttttcacactgtaactcgaaaaaataatatttcacttaaaaagacaataaaactacggcagggatctcttctacattttaacaagtctgaaccatgaaattcaagggctaagtgaggtaaatatctggcacattttgctgttttagagccatttgctgatgggataagaatgtgaggaggatgggaaaagggagaaagaaaaatatgatatattatttctctctttggaatctgcaattgaacaaagcatctcaacttaaaaacatcagctctgtaaatgttttgtagattaaatattttgttattctttgttccaaatatcaaaacgtaatcttgtctcattcccctgtgtctgggaggtaggaaggcacaggtttccctccttattgcaaacattccgcagcacaagtccaagaacctagctacagccaaggaacaggtgaaggccagctcattacatttcaactagaccctttttaagaatcaccagtgaaccttaaattcagctgattttttaaaattgaaaataaaaaagaggccaggtgcggtggttcgtgcctgtaatcccagcactttgggaggccaaggcaggcggatctcctaaggtcaggagttcgagaccagcctggccaacatggtgaaacccccgtctctattaaaaatacaaaaattagcttggcatggtggcgggcacctgtaatcccagctacttgggaggctgaggcgggagaatcacttgaactcgggaggcagaggttgcagtgagccgagatcacgccattgcactccagcctggacaacagagtgagactctgtctcaaaaaaaaaaaaaaaaaaaaattaaaaaaagaaaaaagaatggccacattctcttagacctttgacttccaccaaggcagtggtcaggaggccccttcagggcctggatgggtttggcgcctcgtgtcgtctagggagacatctgaaatgtcaaggaaagagcaacagacagacatgcggttagaggctcgagtttgaataccagctctgtcacattccaacttgggcaggtcacataactattgagttccagtttgctcatctataaaagggatgataataaatatatcacagaattattgagaggataaaggagataatgcatgtagaattgctgaacaactggagttattatttgcagctcttgttaactagggcgtgaaaatgcataccagtcttgtctgtaaaccctttattgtttaaataaaaacattttttaaatgtgctggctggtcctcgatttgaaataatggagatctgggaaccagaggaaaaaaattccctagttatcacaggcaaagaagagtttgaggttggccagggtatggtgctgtgctctggagagagatgagggagaacaggctctggctagagaaatggcctccagtttctacaagaatgaggaagacagtccttgcccttgctgtcctggtgtatagggtagtgctgcgcagctgaaagtctcggcttgaattgcagagcacagagaaatgccatctgtcatttctgtctttggcattttttagatatgctagcaacagcacctgctcatttacttgtatataactcaaaaatgggaggtgaatgtcctagacacagcctagatgggacacaggtgtgaggaaaacattgcattaactttgcatttttcaaggcttcatcagctgcttagattaaggaaggataaaaacaagagaaagagcaagagaaattaagcaactcgtatgctttcttcccctaagaatcctgattaaaatccaaccacagaagacttgccagcaagttccaatatatggcgtgctttccatagcagatctggctagtggttacttggaggaaggtaacgtgacaacctatacaatattaactcatcctaaatgttgcttagtgaaagaaatataaatctctgagataggtgacacggggatttcatttggaactgaagcccatagttataaaaattcagtaaggaggagaaaaagaaaacaaaataaaactagattgaatcattaatcaaagactgtgtgtatggcttaggtttatgtttttgaaccaacagtaaatagtaagaaagcattttcttttttatgcatgtaactaatatattaatagtaaaaggactgttggctaaagttcaaagtgaacgcttttcctaaaacataaaaagcaagtaaaataaaacccacaaaaactacagtaaacaaatgaatgcattttacaaaataaaacatttcccttggaaagttgagtgaaaacaaatatgtaaatagcttctgtttttatagttaaagctttttaatctctggtgcataacaattgaaagaatgagaacttagacaaaagtatttggtggatttgagttaatgggccaagcaagctttttttccttggcttctctgtcaaatgagtcatagatcgagtctttggtaatagttttggccatggaagggatttctgaaatgccaacgtagttttttttggccatccttgaacttgttgtgatagtataggcattgcttcggtaacatttcatagaggacatgcaaaaagtctctttcatccctctccgaaaattggcattataaattgaatacagagtaggtttagaggctgaagaactaaaggatatccatgtgatagctgtgaaaacaagggaacttttcttatagtcttgttcatgggggtgccatagctgagctacatgaaaaggcagccaggagagcaaaaacaacagatttaaaatgaggaacatcttgatagttttcacttttgtccgagggacaatgttcattgtcctcctcaccgttcggccatctgtgcctattctccaaatatattttatgaccttttggtaaaataaaattatgaggacagatggaatcacaaagcccaccaagaagtggatgacagtgtaggcagtgccttcccaagaggaggggaggaaatagttacaatgactgtcccagttggagccatagaaaaagagcacaggggtcacaaagcctgcatcaaagacccacgatgccgcaatcattttcttggctttttctctggacaccttgaagctcagaggatagacgatggtgtagaaccggtctatgcagatggagaggagaacgtagatctggacacctggagtgagatattgaaaatatcgcacaaccttgcacgttgcactacccagcgtccaccttccagtggtgaactggagcaggacgaaaggcgtgctggcaacgctgatgagaaggtcagcacatgccatggagaccacaaagtagttggtggtagactgagtcctcctactcctatggatgaccaaacaaaccagggaattgccgaagatagaaaacaaccacagaatcccaaagaagatgctggctgtggccacttccccgggtttcagcacatagtgaaggtctgtttggttgctcatccaactgtgctcctcacttaattccatcaggtattggcttggcagaggtgtggctgtttcagtgcagctgcggttttggaggggcaccagaagtgtaggaataatcaaatgtggcttgctgttatccattctgtgagcaaaaaccatattcactttttttctcttaattctggttggggaaaagaagaatgaggcctcctgttaaaaaggtgtcatacagattggttatgattactcaggctaacgatcttatttgacatttacattgattgtcatttgtctttgtgtaggacttgagcgttggcaggaaaacataactactatccagaaaaaattctggccccaactttgttttcattttaggagctgtttcagcagatctcagctcaggctctctctggcctcaccttctcttgacccttagtcataccgagctcccctcctacacatatccttgttcccttcactcatcagggatcacagaatattagggatctcaaatctggctcatggtaacggtgttaccaccaactgaagatctgctggaattctgggcaagtatgtgagaagttcctaattgtcctaaggttgcaaaagaggaaagcttgggcagatgaaaacacacagattttgactatggaagtagctaacagcagtctgtgaatgtagacaggctagctactgggaagggtgctgtccttacttagtgtagattttccatcacagaaggattatggtaacacatggagcagtcaacactgctacatgagccagaaatagctcctaatttaatgacatctgaaaatagcttgctttttctaaaagacgatacagttcatgcactaatagcttgccacctaccagtgacatatattttgatgctattctgttgttattgtttcataaaatactgactgaagaacatacaagatgtcctctaagaaatgtaaccaggttacgggagaccttatggcagtcaggtgattaaaaacaacaaaaaaatgtaactgttagctaagcacagtggggaacacctatagtcccagctactcagaaggctgaagcaggaggatcagttggtccagaagtttgaatccagcctgggcaacatagcaagaccctatctcaaaaaaaaaaaaagtaacttaaaattactaagcactttttaaaagcttataaagcttacaaatcttagatacaaaagaatattttaaagtttagcctttattttgtactttttgtattattcagtgagaaaaaaagtcacactgtttaaataggcaaaaagattaaatagttgtgggtcattcaattaaaattgaggtgattttgctcacagattataaaggcttaatttggtctgaatccaggaaacaaaaagagaaacagtagcaatttaatccataataaccataataattatggttattaaggtaagataaggataaacattaatattttcaaaaatgtgcccactaaaagtaaaagcccatgtggggttacagccaccattttgcagagattccatctggcctgtggcacaaggggatgtggctccagcaacaggcttttctagtagtcactagtttctttcctggtgggctcctgtgtctgcacctcacaaagaaacatttctcaagtgacagtcaggattaaataatagttcataatgaaagaacggttcttaatgactaatattttcttttttttgagacagagtctcgctccgtcccccgggctggtgtgcagtggcgcgatctctgctcaatgcaacctccccctcccaggttcaattcttgtgtctcagcctctcgagtagttgggactagaggcgcgtgccaccatgcctggctaatttttgtatttttagtagagaccgggtttccccacgttggccaggctggtcttgaactcctgacctcaagtgattcgcccgccttggcctcccaaagtgctgggattacgggtgtagcaattgcgcccagccctcattttttctttgagggatttttgtactaatttgtggtagagaaagaagtgttaatatatataatcttcaccaaaaagctatattcaatacaagtctagtgctcaaggcaatatactcaatgcctgttctatattatctttaggcttttttgtccatgaggcaaccttacttaagaaagcttaagtaagataattaaaattttaaaaattaaaaaaaaagtttttgctcaccacacagaaagcaaaaataattaaacattttgactactaaaagatctttaagcatgctgggaaaatgatagccaatggtaagaatagcaaccatacactttccatataagaaatcagggccaggcgcggtggctcatgcctgtaatccgagcactttgggaggtcaaggcgtgcaaatcacgaggtcaggagatcgagactatcctggctaacacagtgaaaccccgtctctactaaaaatacaaaagattagccgggcgtggtggcaggcgcctgtggtcccagctactcgggaggctgaggcaggagaatcgcttgaacccgggaggcgaaggttgcagtgagctgagatcgcgccactgcactccaggctgggcgacggggtgagacgccatctcaaaaaaaaaaaaaaaaaaaaaaaaaaagaaatcaggacataagatctaaaattagcattgtcctagaaaatctggactgcaccctcatacatataagattgaaatcatcttttcgccttcatgtgtgtaaaacctattaaactttttaaaaaacctgttaagatttaaagtttaaaaataaactaaaacagacaatttccccagacagaaaactgttctaacttttctgggatgcctgtggcctgaataaaacaggagtccacacaggcacttttccttaatgcgcatacttgaaaacctgtgaacttccttctgtctctttcttcctctaacaacaaaactctgcaaatgaaactcaagctcaccgctttaactaaagcccggaggcggggggcccttccatcatttcctccagctgctttacacccatgagtctgtctgcccatttccccagcccaaccacttggaagcagaggatcccaatgctcagaaacaggacgagggagcccgaggagttcctgagtctagatttcccctgctggtggcataagttctcactccacctaaaatcgctgcagttctgaatattcattcaataagccgagaaactgggctaggtattaagaaaacaaagatcggccgagcgcggtggctcacgcctgtaatcccagcactttgggaggccgaggcgggcggatcacaaggtcaggagatcgagaccatcctggctaacacagtgaaactccgtccaactaaaaatacaaaaaattagccgggcatggtggtgggcgcctgtagtcccagctatccgggaggctgaggcaggagaacggcgtgaacccgggaggcggagcttgcagtgagccgagcagcctggggcacaaagccagactccgtctcaaaaaaaaaaaaaaaaaaaaaaaaaaaaagaaaacaaagatacgtaagcagtgtgccatattataactcaatttgataataattataattcactgctaagaacagaactttgtacaaggagctaagtaagacaaaaatagggacccagttttgcccgggtaaggggaagaaaaggaaaggcttcacagaagaggtaaagtttgagctgggagcttagaggatgaataggacttcttcaggaagacaagtgaataaaacattccaggggagagagatagcatgtggattgaattttggggtcatttttctgggttgatcttttttggggcccttttcccctcagaaacatagtttccttcagaccatgcctcccagagtatatagtttctaaatgccctacaatcaaactgatctaaatttttcccctggttacaatgagaggttatatttgctgcattcatgggcagaaatgcggtcagacagtggataagaatattagcatatccagaatggttgtggtacccttgctcatacagcatcttgttagtcctttactgcagcattttccaagtttgtttttctctagcttagcaatacagtagattggagtcttccaggcagccttaagaaatattgatgcctgagtcccagcttcagggattttaatttaattgctctggagtgcagcctgggtgtcggatgtttcaaagttcccaggtgatcctgagtgtagccaagattaagatctgtgctttagaaatacctccatgtttctgtcttctccaataaactgtggactccagtagggagatggggatgttattctttttctccatgctctacagcttccactgaagttctttacattaataattgcttattcgatgtttactaaattggatctgtaaggacagagaactgaaataaatgactcttactctatgtgcctctgctaggagaattaaatgcacatagaaaatcactatatattctcagagaggtgaaacattggggattatggtgataggggaaaacatgactcctgataaaagcagggcaggtgaaactgaagctaccaggtcaactgctatatgaaacagatatctcatctaagggaaagccaaggtaatttaggtgtcctcagacaggttcttgcactttcctcccagaaaaaagtctgccatattataactaaattctagggtcccaaagtaaagtttcagaaaggcctcccctgctccattaatttagataaaaatatatcttcaagggggtgtttctgaaatataagatctggttaattagtaattctgttcagagccatccatatgcagtaattttagcagtgacaagaaaggcttcttcacctctttcctgttcgacctatctcttcccagccagttctgagactaccatttgacatactcccttggctgaggtattgaaggtccttatttatctctacctatatatgatctaaaagaggaatcattcatttatcctattatctacttctcacccatccaagctttaagattaatacatgagtggggaaaatggtagatgggttgtcatagcacagaactgggggccaggcatggtggctcatacctgtaaccctagcactttgggaggctgaggcgggcggatcacctgaggtcaggagttcaagaccagcctggccaatacggcaaaaccccgtctctactaaaaatacataaattagccaggcgtggtggcatgtgcctgtagtcccagctacatgggaggctgaggcaggagaatcgcttgaacccgggaggcagaggttgcaatgagctgagatcacgccactgcactccagcctgggtgagagtgagactctgcatctcaattagaaaaaaaaaaaaaaaaagaactggggactggttacccctgtaatgatgggatcctggggcacctgggaggagaatgtaccctatcactttgctttgtaatttttattttgcatgtttgtctcccccattaggttatgagttccttgaggataaggactatgtctttacttctatatccctggggcacatagctattaaaaaaggtttaatgaatatatgaatgggtggatatgttagtaaaaattatccaatacttgaaaataaggcaaaaaaggacatatactcttaagatcttgctgggacattcttaaatgggcctctctctctgggagaatgtacctgtgcttgactttgctatttaatatttgactagagctgagacattgtgaagatatttatatgttaacttgtagatttctttctagcagaaaataataaccccaaaggttatggacttactgccctctaggacattagccagtttagtgtttacctagcaatcttatgctgaaattctttttaaaaaatgcctataaagatgcattcttcaaatgctcttggaaccagctttattatatcattggttccttcggtattatgttaataaatctttaacatatgttcattcaatatttgtaaaagtcatgattctaactttttgaaaatcatactttgttggatgcaatggatggatgaatgactggaagctaataagagggagcggaggaccacagagaggaatggggcatggatgacaaactttgcttcacaattctgcatcaactgttggataggttttttagttagtctattttttaagtctaaaaataccctaacaactaactttttgtcctcttgagattataaagattcacaaacattctcacaaggtataaagaccatttttatttcttgagatttgtttaaaaatttaatgtcaaacaagaatttttataatattgattttttacatgatttggttgaaaaaaaaaaacagaaacattttctgtagaatgggaagtatctgctggacctacatggatacatatgggtatttactaatgagcagtaagattacaatcatgacagtagttatagcattaatactaccaagagttaatacttatttttgtgcttactatgtgccaggcactttatatgtgtaacccctcaaagtaggtaaaattactggccttgttttacaaatgaaaaaaactgaagttcttccccaaagtcataccgttggaaagtggtcactccaaagcccttgctcttaactaccatcagggtttcctgaccagtgagaccacagagggctggatctgaattcagagagtcaaattggctgtacatgggtaagtctttcttgactattcattcaaagagaggaatacaaagttattccctatagcctcttgcctacccacagatacatctgttcaatatgctagctcagaaatatgtgacatagtgaacagttttaaaaaatgatcactcccacaacgcactgcacagaagcttagcatcaaaagtgcgccagacatgctggcctggagaaatagcctttcttcagaataaagagtgtgagagtattggcatttcaacatgctgcataattaactgttgccttttaaacagaatgaaagcagaattctagacttcaatttgaattgaaatgaggaaaaaatttgatcaattgtattatcccaagtaggaaattatcttttaaaattttagttgtttaaattcaagaaataccacggtacggagattttaaggtaaacccttcattgttgtgtaggcttgatttgtttacatgtgaaaatgagaaatgcctgtaacactagtgggctgggactggcttacatagggaaccctgagccaactgtatatacatttcttcccaactccaggctcaaagacatcatgttggcatcatgaagcagccatggtaggagtatggcaaacaccaaaaattgaagttttgtttttttcccccctctgcagagccagttgttaaacatttacccgcacaccacttccagtagggcagggctttcagggcagcctatcctaagtcctgaacttacacacattgctgaacttaaaaatggctcaggaggccacacaagctcttctgaagcttcctaactgactctcttgctgtgtggccttgagataaagactctggtgtatgtgtgcttgtgtgtgttttatagagatgaggtcttgctatgttgtccaggctggtcttgaactcctgggctcaagcaatcctcctgccttggcctcccaaagtgctgggattataggtgtgaaccaccatgcccagctgagaaaagactgatatgaacattaggtgatttataaaactacataaggctaggtagccaccagcatgactgtgtggggtaacaggaaaatcagagagggtgagacatgttcttacaatgtcgactcagatgaggttgctagataaaatacaggatgcccaggtaaatgtgaatttcagataaataacaaataatttttttgtaaaagtatgtcccatgcaatatcccatgcaacattttactggtgtcctgtattttcatttgttaaatctggcaaacctacacccagaatgtaatcttctgctaaaaaaatctcatgttttaaatctcacagtgtaggcatactgcaaagtggatatgtatgtaggctttgaagtcagttgcatcctattcctgtcactcactcactagctgggtgaccttgggcaagttacctaaccctcttgagctccagttttcttctgtaaaatgaagatagtcagttcctatctcatttgattattataactagatgagagaatatacacaggacttagatgagttaatacatgtgcatctgcctggtatgaggaaaacaacaggtgttatttttatatacagttctacaaaacacctagttctgtgtctggaacaaagcaactgcttcaaaaattagtcttttaaaccatatgacaaacaaattttagtaaccatattacacatcacatactatagtaataatactaacattggtcacataatttagctttgtcaagggtaaatggcttttgtgaaggggcctgggtacctaatcatcatttacaacaatgtttttaagggggaaatcattgaggccaaataaataaacacattttctccaagttgtggatgattttatgtgacatgttgtccagatcaaactttttaaggtatcctacatcaaaatacataatacaactggattgaatacgcctttttcaaaagcccatagaatctattctgcttaaattatttccattagaggctgggcatgtaatctcagcactttgggaagccgaggtgggcagatcatctgaggtcaggtgtttaagaccagacaggccaacatggtgaaaccccatctctactaaaaataaaaaaaaaaaaaattagccgggtgtggcggctggtgcctgtaatcccagctactagggaggctgaggcaggagaattgcttgaaccagggaggcagaggttgcagtgagctgagattacaccactgcactccaacccagacaacacagtgagactccctctcaaaaaaaaaaaaattgtttccattagatattttaaataattgcaaaagaacctcacaccaatgaaaacagagcttctttccaccacctgaaactcctggtgccacaagcttataggcctggaattttctctactggtctttttcctttcctccttttatataatatatataagtattcctccataataatccagctctgtacctttcaaactgtttcctaactggcatcaagcagtttctcaagctcagactgggtatattttctttttgtttggaaactcgatatgctttcatgggaacataatttttttttaaacagagatgttttcaaaacagcttcttctaacttcacaaaatagcttaaaacaaccatgaacattcctggctcagaaattctgcctatgtagatttaagggactattactctcctatcacatttgcctctttctttacccttcacatgaattcaaaaaatcaacctctctcacaattacagcatcatcctttaaagtgaagatccctattaaaatataaatgtttcttaaagaccagttgtacatttttttcagttttatattttatcagtagtgatttctgagacctattcattctatctctgaaatctacgattagtgaaaatgaaaacagaagagatgccaaaagcaaaagccgtgaggaccatcagtaactgagagaattaagatggggtgtcattatgagaagggccgggtgaagggtgaaaggtgaagttgaagaagataaacttcacctccttgacagttttgtgaaggaatggataaccactggtagctaccctacccaaaggaataaaacagaaaggagcctgagctttaccccacatgaaggtttaagttgaccacaggctgcagtcctcccctaattccttgtaaacaatgttgcatgacaaaaatgttaggtcgtgttggcatctctttgggggtgaccacccccacggatgtataaagaatactatctaatatttctcttcccaactgctgcttagtagcttagtagagttccgtgtatacaggacacagctgcaggtttaatactgaacttccctacctccctacattcacacaaaatctgaaaagtaagatacaatgtaaaaaaaacaagtgcaaaaaaatttcaccctggctgggtgtggtgactcatgcctataatcccagcactttgggaagccgaagtgggtgaatcacttgaggttaggagtttgagaccagcctggccaacatggtgaaaactcatctctactaaaaatacacaaattagccagacgtgatggtgggtgcctgtaatcccagttatttgggaggctgaggcaggagaattgcttgaaccccggaggcggaggttgcagtgagccaagattgtactactgcactccagcctgggtaacagaacaagactccatctcaaaaagaaaaaaaaaaaattcaccctaagaaatgaccattttgttatgatggcatatgcaaaatagtcttcaatcataacatttatccattttttaaaaagatcacttagtgtggccagagttgtgttcattgctggggacacagacattataataactagacagacaagatccctgtttttatggagcttacttctaacatgggaaacaaataataaacagctaaacaaataaaaatgtcaataattcagaaatgattagtgctatgtagaaaaagaaaacagaatgagggaccaagaattgacgggaaatggaatggcagatggctggttagctggttacccaatgaccattcccaactcctccctctcctgcctcttaagaggctaaaaaggtaagataataatttccccaccatccctttcagttaggtgtggtcacatcaatataatcttcttctggccagtgacaagagaaagtctcctggcagggtgttgggaggttcttggaaaaatgtttcttccttgataaaaggaaagaggtgtgtagtgagtattctcatgggcctgactgcctctctgcttcttgccactgtaaactgtcacatgaagatgtcagggcactgggtggtatcttctgaggtcaggggaagtcctgagactcaccgggacatagtgccctgacactgtggtgctgctaggacactcacctccagacttactaagtaagcaaacaatgtctttatggcttaagccactttgagttttgttactcatctctgaaagcaccctgtctgaaacagggtctggttttagatggagtggttagagaaaggttctctgaagaggttatatggcagctgaaaccccaacgacaggaagtccgccataacattcaggcagaagaaatgatgagtgcaaagaccctggtgtaggaatgagcttgttatgtggctacagcatatgaataccaaagaaaatgatacctgatataaccggaaaggtgggcaaaggtaggatgacacagggcattgtagggcatggttttagtctattgaaggaaaattcatcgcaggtttcaggcaaaggagtgaaatgaatatgccattttttttaaccccctcacgcacatttatgttttaaaaatacaactttagttgctgtgtaggtggccaagcatagaagcagggagaatagttaacaggctattacacccagcactttgggaggccgaggcaggtggatcacttgaggtcaggagttcgagaccagcctggccaacatggcaaaatcctgtctgtactaaatatataaaaattagcccagcatggtggtgagtgcctgtaatcccagctactcgaaaggctgaggcaggagaatcacttgaacctgggaggcggaggttgcagtgagccgagattgtaccactgcactccaacctgggcgacagccagactttgtctcaaaaaaaaaaaaaaaaaaaaaaggctattacagcctgggcaacatagtcagaccctatctctaccaaaaaaaaaaaaaaaaagtaaaaatttgctggttgtggtgggaggctcccagctacttgggaggctgaggcaggagaactgcttgagcctaggaggttgaggctgcagtaagctgtgatgctgtgatcacaccactgctgatgatggtggcttagaccagggtgatggcagtgtaggtggagaaaagtagatgaatattgaaaatattatggagacagagccaacaagattagtttatatgtgatggggttagggaatggggatgacccctagttttgagagcctgagagcaagagagaaaaagtttagggagcttgaaatcagtaatactactatacacaagttaaattcccactagatatccacgtagagatatcagttggctattgaatatgtacatttggaaaaatctcttttgaaaacctgtgcccatttgaatcaattcattcatcactccataaatatacactaagatcatactacactccagaatgtactatgttaataattagatatacaatggtaaaccaaactgtatccctaccctcatgaagatctagtataattagttgtagaggggtagagagtagtaaacagataagaagaaatgaatgtattaagttgtagtaagtccaatgaaagaagagtaggctgctataagagagcatggtgaggaccctcccctgggctggggtcagggaggcaatggaagcagcagcagagatgatgaagaatggctcatctaaggtagaccctccaggacccctgctgctgacagatgacaagagagtctagccaacatgccgccttgggtcccagccgtgttccaggtccttaacaacgttctaggctccttgaggcctggacttaggactgttgtgatagtctgttgtcctggaagcaattcagaggtttttttatagacaaaagaacctaaatcatcacgtggggagcaggttagagagaaagagggataagtggagccgagaggaacaaagtatccccatagattttgttctgtgtaagaaccccaggacctaggaaggggaagagagtctcagtaatgtttgccattgatgttcccatcagcctggtaggatagagccttgccgttatttaaaggaaataatgtgagtagtaggcagaatggttccccaaagatatccatgccctaatccctggaacctgtgaatgtgttatgttatatagcaaaagggattctgcataataattaaggttatgaaccttaaagtggggagactatcctggattatccaggtaggcccaatctaagcacatgagcccttaaatgcagggaactttctctggcagcagcaggagaagtcagagagactccaagcatgagaaagaattgacatgctattgcaggctctgagatgcaggggcccacatagagggaccaggatgaggcctctaggaggtatgatggctcccacctgatagccatcaaggaaataggatcttagtcttacaaccacaaggcaccggattctgccaacaacctgactgagcctggaagggcagtcaacctcagagcctctaaaaaggatcacagtcctgctaagatcttgattttagccctgggagactctaagcagagaactcagccaaacccacccagacttctgatgtacagaactgtgagataataaacagtgttatcttaagccactaaatttgtgttaacttgttacagcagcaatagaaactaattcaatgtagcatttcttatataatttaatttgagtactaaaattcataccagtcattctatcaccttctaataccctactagcacctgaaatattagaaaaccaaaaatcttaaagagtatagtgctttctacttcaccttacacattgggctgggggctaagaaacctgggttctaattctgattataagcactgaacaagtcaagagaccccggtcttattttttatttcagcataaggaccttaagtaaatcaacctccttgaacctctgtttccatatctacaatatgcatgagttggcctagatgatttctaaggtcatttcagctctatgagcaaaaagtgacaggtggacattgttatctgagatgagctaatttaatttataacccaccactttcatctggcagagagctcatcctgagagtgcattttgatgggaggagagggaagttgtttagggctgctggggcccagcactgagagtttttgatatcaaggatcagtagcatgggtctccaaaggaaagatgaattttacctagggtccagcccagctttccacagtaattatcctagatgtgtcaacaacttcttactgaagattccttgcaagaagtggtctggtcaaagaggacctgccacctgtgtttgctttccattctatctaataccaaacctctcagagaagagacacatttctagaacccccgagtgtcctctgtcagtttctacacgtttcttcccagtatgaggtctttcaaattctgaagaaaacaatttggccaaggaatttgcacctcactaaattcaattcactacagcaaacattttttgaacacctgctgtgtgctcattgagttagtgggaaccagttgttttggaggtaaatgtttggtttcatttctaagttctgacttcagtatcaagaggcaaagactagacttactaaagtcaaagcaaagaacaacgaagtagttgagatttacagctatttgaaaaggaggtgaaggacttgttaagaagcgagtataagcactgagcaggaagttactaagcattatttctcaggagcattcaccttctgtctcacatcttattcacatcaacattccgggtaaattttgatctgtaccactgtcctcagtcagggttttctagaaagcaaccttcaagtttatgaagcagatgttaattttttttttttttttttttgagacagagtctcgttctgtctcccaggctggagtgcagtagtgcgatcttggctcactgcaacctctgcctcctaggttgaagcgattctcatgcctcagcctcctgaatagctgggattacaggcatgtgcaccacgtgcagctaatttttgtatttttagtagacatggaaaatgaaaaatgaaagtctttccacttatatttgtatatttgctctattatttgagaattttcaattctgcgttacaccatgttggccaggttggtcttgaactccttgcctcaagtgatccacccgccttggcctcccaaagtgctgggattacaggcatgagccactgcgcctggccacagatgttaaatttaatatcgcattaacatgtattttttcatggacaaattatgtgactatatgaaaacatggctgaacatgtattttcatatatttcacatggataatatatatattcagtatattagacagtttataaatgatcatttctcagtgcttcttaattcaatcctctctgcatttcagtaatcgttgactcaaatcacctatgctggctaggcagggtggctcacgcctgtaatcccagcactttgggaggccaaggcgagtggatcacctgaggtcaggaattcgaaaccagcctgaccaacatggtgaaaccccatctctactaaaaatataaaaattagctgggcgtggtggtgggcgcctgtaatcccaactactcaggaggcagaggcaggagaattacttgaacctgggaggcggaggttgcggtgagctgagatcgtgccactgcattccagcctgggtgacagaacgagactctgtctcaaaaaaaaaaaaaaaaaaaaaaaaaaatcacctatgaagcaattttcaacctttcttcttcagagacacatcacaaatgtgttcatatgtgtgatatacccccatatatccagaattatgtgcaattctaggagctcgacctgtaattccaaccctttaatctccatctaagaaatcatactgaaaaaaatattgttatgtatatacccttaaatttattccaattaatttaaaaaaaccaatgattatttattagtaagcagttatttgcaacatgctctgtttaggacatagcaatatattttgacacctttgttgatatgcacggtcctgatatgccacaagtataacatgaaatctaaattcttgaaggctaaggtgcttggcacagagaaccagagaaaggtaataagagagaaaagtgcacttattctctctgctgggcaactgtgagcttataactagttctccgagtctactaataagcatttaataagaatctactaatgagcacttttcttgatccataaagtcactattgacattccagcaaagtttcacggcctgcccccaatttgaagatttatttctctctttggatatagaacaaaataactttatgtacattttatttcactttattttactttattgggttggtgcaaaacaaattgcagttttcccatgaaaagtaatggcaaaaactgcaattactttcgcaccagcctaatattttattttgagacagagtcgcactctgttaccaaggctggagtgcagtggtgtcatcccaactcactacagcctctgcctcctgggttggagagattcttgtgcgtcagcttcatgtgtaactggaattacaggtgcacgccaccacgcccagctaatttttgtattttttgtagagatggggtttcgccatgttgccctggctgttctcaaactcctgacctcgagtgatctgcccacctcagcctcccaaagtactgggattatagacatgaaccaccgtgtctggctctttatgtgcatttttaatatgaagaggctatatagtatggtggctgagagcacaggttctagactagtggttctcaatcagagataattctgcctcacagtgaacatttggaaatgtctagagacatttttagttgtcatgtctgagagagggaagtgttactgacatctggtaggtggaagccaaggatgctgctaaacattctacaatggtttgggcacagtggctcatgcttgtaatcccagcactttcggaggctggggtgggagcatcacttgaagccagaagtttaagacaagcctgggcaacatagtgagtccctgtctctatcaaaaaaaaaaaaaaaaaaaattagccgggcatggtggtgcatgcttacagtcccagctccttggaaggttgaggtgggactatcatagacctaaagggaaaaaactaacaagcacaagatagggtatgttagccctaggagtttgaacctaggagtttcaggctgcagtgagccatgagtgtactactgcactcgaggttgggtgacagagtgagaccttgtctctggaaaaaaaaaaaaagcccaaaacactacaatgacaaggacattccccgacccccaccacgacaaagaattatctggccccaaatgccaatagtgctaaggttgagaaagcctgctctagagtcagcctgcctggggttcaagtcacttataatctgtgtagctgttggtaaattattttacatgtttgtgcttattgggtgtcttcaacaataaaattagaataaataataacaatactcactttattgattttctatgataataaaataaattacacaagaaaggagctaaggacaatgtctggaacaaagcaagtgctcaacaaatatttgcttttgctttcattatatgcattgaaaaaaaattgagaagaaatacaccaacattttaacagtgattgtttctaggtggcaagatcacaactgatttttattttcattatccttttatactgctttatattttccaaattttctagaatgatatttgtattactctaatatccaaaaacatgttttaaaagaatgcagataaaagaactttatttgtgatatagtaaaaagagcacagaattaaaaagacctggattcagatcctgactctacctgccgtctgtggacattgaataggtaagttaatctctttgagcttcagtttcctcagctaaaattggggctaataatgcatatcatagagagttgctatgagaattaaacatgacagacatgcagtgtctgggagagtataccaaaggaaaggctccaggagatgactgctttaaaggtttggccaagggaaaatgactccacaaacagggaaacatattcatgatggtaactgcccttttgccttttattttttgttttttgagatagggtcttgctttgtcacccaggctggagtgcagtggagtgatcaccgctcactgcaccctcaacctcccaggcccatgcaatcttcctacctccgtctcccgaggacctgggaccgcaggtgtgtgccaccacacccagctatttttgtagatctccctatgacttttttttttttgagacagagtcttgctctgtcacccaggctggagagcagtggcaccatctcagctcactgcaacctccacctaccgggttcaagcgattctcctgcctcagcctcccaagtagctgggattacaggcacctgccaccatacccagctaatttttgtatttttagtagagatggggtttcagcatgttggccaggctggcctagaactccggaccttaagtattctgcccccctcagcctcccaaacagctgggattacaggcgtgagcaaccatgcctggcctaaggtctccctatgtttaggctggtctcaaattcctgggctcaagcaatcctcccgccttagcctcccaaagtgctgggattacaggcgtgagttatggcactcagcctccctttttctttttaagccatcctctcagcacaactcccatgtcatccaattttttgccttggctgatggagaagaaactacgtccacactctggtccttctctctcctctcccctccctacatacaccctaggaagggatctgatcattcccctggcaggccctgactcatttggcagggtttacttgcaggcaagctgttgtgtccgaaaggcaggacccaggtatcactttctcatagtctttacccatgctcattgtccctcttcttatttctgctttcacccctcacctctaggttgaaatcatacttggcaaggcctctcctcaaggggaagcctctccactttctctccctctgttctatcctcccatttagctggttgagtaggttgcccccttttagactccagagggatgtgtaggaagcccagctaggcttccagatccatgcctcatgtgtgtgctagccctgcttatctgagaagccctgcatgtgtggggggcatgtagcacttgccagctggtttgtgcttccgtcagggctgttgtctgttttgtgcagctcgctcagcaggtaatgtttgaggtgagcagcatgagctggtagaattcaaggacacacactttatccacaaccccttaatgatttaattagatggaaaaatcatagattatgtttgtgtatattatcaggagggtgactactttaagccttactatcttgctaacttgaatttaaatcctgaccaagctttcaaaatgccccaggaaaatcttcttcattcaggacaatcttcttcaatcatgccatggtttgggaaaggtagtctgaccctaacccacactgatactcaagatcccagagttccctaggaaatagtcctgcagtcctgtgagctttctatacagagttctaaggactgggagtcagactggattaggagagaattgcctgaggcaggagttgacttctcaagacattcactctcaaactgaattaaactgtttcaacgctgggagatggaaccacccaaaacatcagaggaaaataagactgttaggggtgcttccatttagatatgaatgaaaatatcaggagaacttcattctaaatataaataaaaatgtcagggggattggtgatctccaggaaataatttatgtatactttctaaactgtaatttgtagctgctccagggccagcctaactatataaacttcaggcataattttgactgttgccaagttcttactacacatgtgtctcctcactgtcctctctataaatacatgcaaaataaaacaggcatggactcccaaattggcaccagcagaatatgtcattgttttgagtcttctcagtcttcattcacaagagtatattgagagttcaccataaaccaggcctggtgataagtgctagaaatccaaagaggaaaggataccatccctcaagaagctcacttcatgtgactataatagcatcaaagtgttacttgttccagaaaaatgtagatttcagcagggatcaaatgcttaagctaaaagactaaagttcaatattgtaggggacacaattacgtcttaaagtactgcgcaatgaaaccctgaagggaactggtaacttttcttagtttttccatagcttataggaatcagatcagtcatcttttattatcaaaggccagaaggaaatctacacagatcaaaaaaaggaaatctttatacctcagaaatttctagcagttaaaaaaagttattagcaaatctcctcttttacccttaaaaacctaaaataatttgcaaaagatacctattcccttattttaggtataatatcattttaaaaaataaatccagtcagtttgatattataatttatatacatagttttagaagtttttaatctattttattttgagaactaggtaggtgcttttaaagaaaatatgcttaggctggccttgctaggttctaggatggaagagtgtttctacgttcgattttttaaaaaacccatgatataattctagatttcttttttcttgagacatcaattggtcaccatagtaacatagcgttttactacagagatctatacagcacaagggaaacagaacggcaattacttactgggttacttgggggtacagaatgtgactacagggataatttaagattaaatatagatttctttggggatctgttttagcaaagcaagctgattcaatcttctagtagcgtcagctgaacaaaatttgaagccaaattgactgctgacatcatttgaaataatatgagcaggcaagcagcatagctcagtggttaagagcacaggctttggggtcaagtttcgtaggtccaaattctgcttctactgtttgctagctgtgtgaccttgggaaagttccctaacttctctgtgcctctgtttcttcatctctaaaatgtgggtaataaaaccttcctcaaagggttgttataaggattcaatgactgtttgtgcttagaacagtgccttgcacattagaaagaactttcttaagtatttgttaaataaagacaaaataaaatttaaaggggctcctctctttgtgctgaaaatagtcaaagacatgaaaatttgagttcacggctgattattttagcctgtaactttggtagattcctttgagaacttccccagggtcttgttgctagcatttctacaagatgtgaaattctgtggcagtctactgtcctaaatcagagctgggaacaatcacaagcacccctggttccaggaacatcagaaggaagatgatcacacagcacaaaggaacagcacgcctgcccacttcagctccccaagccctgccaataacctctgggaacatgggcatagaataagcagctgaaaaaggatgaaacagcttttattacagtgatgatgaaacctagttggtttcggtaattttttcccctctttccaggcttcaaggggaaaaaatccttttcatcaatgagtgctttgtttcattaattatcactatacacaatttccatccaatttttcaactgacacatactctgatgaattttcattttacagaactacctaggcatcttttctggactggtaacaaacctaaagcctctaaccagcatctaaggcaggacaaaatctccaaattgcctggaaaaaaagaaggcattatgtcctctgagccaaatttcagtcgcaataccaagggatccctatcacataccttcatccggacttgatttcagagacgttctctttagatcttcttggtcaggaatagcccttgcataggagtttggagaatgccataaaccaccaggaaagcctggaaacacattcatttctgtcctctgccttccccttggctcacagcctgcttcctgttagggagacaagatgacgctgtgcagggtagactgttaaaccatcttcccgcccccagccccactctcttgttgcccctcccttctcctttccaaggctctggaatgtgtcacatgggaaatggatcatgtggctgaaggggagaatgtggccatcttctccctcccttcccccacttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaatttccctgaggtcctgtgcctaaacataaaccacaccatatgtttagggctctgacttcccctactatcagcttactgttaccttataaacacaaacataattttcaaatttccttaaacccaaaagaccatcccatacctacctccctgtccccatcccatcacccatcctcactctttaaatatggtcttttttttttttttggtgggggggagggagattcctgtaacatagtttactgcatgcccaaatatctatgcttatggggaaaaccacagaaacacataggaattctggggtgtacaagtctagatgtcattagccccatccctaggcctcaggcagggctgaactggagaggcagggagggagcctgcttggagctgttttgtgcagggtctatcctgctttgctgacgtcctagttgccatggtgctaggtaactgctgaagaggatgatttcttttaaaaccggtcgccatgggagcctgctgactaaagaaaggaagagggaaaaggactgaattgctgaggagggatttaaacagtattctcagagccaaattggattgctgtcggtcctaaatcttgaaaggaatctaggaattagtatggacactgcaatagttactctccccatcctccactgcttctttccttaaaaatctagttaggtgcaactgaatgaaaattccagcttcacagattgaccctgaaatgccatcacagggtggtggaaagaactcaagaaatcaatttctcctcaggttagaatatctgacttttgggaagccattatctaagtcctaacagccttaattgggagatactttagagccacacctgactgtcgatgctaggaacaatgtgtggattctttataacactatggaagaaaagacaattttttaaatgtgagttgtcaaattattttaaataaatacaaattttattaatacttggatagcatttggattactccaagtcagaaatacaaactggctatacatttgtctcataacactggcatataacttgttgtttctaactcagaatcctaaccaaagcaattcagaatatttattttttgaaagacgaatgctgacttgcaatgtgtagaaatgaaaactttgtaagcaaagaggtggcacaaggaagctggagtataattttcaagaaactgaaggtccttcctggatcaacatcctcatcgtattttctacttttattttaggaggagtgaggttaattctagtttttctatgtaagactcagagaaattcaactgttaattttaacacttgacattttaagaaaattcatttatcaaaaaagttagatattgaagaaattctttgagtcagcaggttggtgacttggatatcatctcctctcttagtcaagaataattacaacaataagaacaactaatatttaacatgtgccaggtgtttacatacattatgtcatttaatcctatcaacccaacaagatgagtactattactggcatttctgttttaccgatgaagaaatggaggcttgggggaataagtaatgtgcccaaagctgcatagtgtgggagctaggatttggaaccactgactcagcctccagagcaggcatagtgtactatgctattctgcatcatgcatagtagactagattaaaataactggtcaatttaatgtgttgtgacttactactatggccccttgacataagaaatcacaaagattgctttaaattatttgagacaaaaaaaatgaccaacatatttattccttccaggatgactgcatgtatatattatggcttaatgatatttaaaatcatcttgtaaggagtcataacccaaaattttattaaggatggtcataaaacatgttacataatatactaattctgcttaaaatatattgccaaagttataatcaccaaatttacttttgacattggaagaagataaagaaacagttgtcttccatccaaatgcacaaaattccacaatacttgtgcaactggggtaatattttgaacatgagtaatgtgatcttctcatctgcctggggaatccatttgccttggagatagtgttttggcactgtttagatgttacaaaaggaatggaaaaaaagaaattaatatttggcttctgaaattcaaaatagaaacaagacaataggcttgaaatccaggctattgttttgaaagccagtctctaaattcctttatttctgcccttagcttgtcatcaaccaaacctggaagactttgctcagtgttctgtactatagacctctggcttcaggtaaaaactttccaaggggtcccaaagcatgcagagttttatgggaactaatttctagatcctcaacttctacaagtatgcattctaaaactgcttttctgagaactggtgcagtcgagatgtcatgctggttcttggtttccacttagcttttcttccatcttacacagattgctgaatctctcttccacctttacctcaaatcctgcgttgtctgaatttaaaaacctcctggggaccaaacacaggaataactgaaaatattggggatagtactgagaaagtgaatagctccaataattaggtaacaaatccttttaaaaatcaagagctttccaagtgctttcaacaaaattggaaacaaaccactacccagtggtccactgagaaattcattaaaatggttttcttaaaacaacgctcttaccaggcacggtggcatgtgcctgtggtcccagcaacacagaaggctgaggtgggagaatcgcttgcacccaggaggttgaggcttcagtgagctctgatagtgccactgcactctaatctgggagacagagctagactccgtctcttaaaaaaagaaagttcttctttacagaaaaatgctagttaataaatacagactactatagttagaacaccatttttgcaacccccagtgaaataattgactcaggaaaagatcacaaaaggtgttcaaagtataagatgaaaagttgttgaacgggttatttgtagattacttataaagtgcaaagggatgtgtgtcctttttcagtgaagagagtgggagggggggtcatcatcttaaccaagtgaccaaatttagcgttactaatagtgagacaagctgaaattatgtgcctaacatgaaatgatgtaacctactcaatgttactgaagtattctttctaaaaatgtttaacccgaatataatcaaatctgtacatataatgtcgagtttttttttttaataaaaaggcaagggttggagaaacaagttataagatattatgaggaaataattggccaaatcaagaatgcataatattctacaagagaactagcatggactcatcaaaaagtcaaatcatgaaataaaaggctgcctaccacagtgagttacctccatgttgagagcagtgctcagggtaagggatttctgccttgactccctttttgagacaactgcccaagtccctcaaacctcattccttgcatttctatggctgttcaggccaagtccacaatagcatggtcagacacagatatgacaatcaattattctaagcctttctgttctcttgaaggatgatgctgaactaacagccagtaggcctgccacaaccaagacaaggtaaccccacagcaggggccaggggtactgagtctgccaggggaggtggccaatactccctgggagatttgtctgaatccaaaggtgggccacgagttcaccatgagttcaccagctgcaggcttcagcatcacaggacagcatgttccccagggatcaggcagacaaggggtatgtattaggttgttcctgcattgcaatgaagaaatacctgagactgggtaatttataaagaaaagaggtttaattgtacacatttgcaggctgtacaggaggcatggtgcccacatctgctcagcttctgggtaggcctcagggagcttttacttatggcagaaagtaaaacagaagcttgcatgtcacatggcgaaagcaggaccaagagagagagttgggggtggtgccacacacttaatacagcagatcttaagagaattcactcactatagtaagaacagcaccaagacatgagggatctgtcccacgacccaaacacctcccaccaggccccacgtccaataccgggtattacaattcaacatgatatttggcagggacatatattcaaactgcatgagggtgtcatcctggaaacttgaaagtacctcagtgcatactctaggtccagaatgaagccaggaggtaccctctctctcatcagtgccacaaggatatgtaattatacccccacttccccccaaacaaatgaaagtcatctacagaaaaaagtgacaggacctctttgggaggtattatgaaagatgaaacatttcatccataggatactaatactatctaaaggaactgaatgaattgaactatatttgaaacaggattagacactttttttttttcctgtaacctaacaggttgtggtggttttaaaatacatccacaaattctttgatatgccttcaaagaatgcatctaaggtctggctgccacattagattttagatgtgaaacctaatccacctccccctgaatgtgggctagacttagttacttctttctaataaatagaatgtgacagaagtgattctgtgacagtttctacctggctctcaccttcttggattacttactctgggcaagccagctaccacgtcataaggaaactcaagctgccttgtgaagaggcccacacatagcaaaccgaggcttctcaccaaccagcaccaactagccaaccttgtgagtgagctgccttggaaggagattctccagccctagtcagtgaccatacccctagctaacatctcaactacagctttgtgagagacccgaagccagatggcctagttaagctgttcccaaattcctgatccacagaaactatgacataatgtttttgtttgtttgttttcttttttaagctctgttgaacttgatattattcttccaagatattaaactgtagggaattttgttatgcggtaatagatgactaataggtgaaaactctagacaaaataaaggacctacattttcatgagatatctgtagcgagttaaataagtgtctttgctatatatgtgtattcctaatgtggaagatacatggttttattaggacaaaaaacattaagaaggggagaacataattaggcacataacactgttgtctaaggagaaaaatgaatccccttaggttgagatggatttattatgactcagaggaagtgcagggaaatcaagaacaaaaagtggcagccagacgttagattagacaagggtcctgaaagtggtcagacccaaggtagctactgactctctttctctaggagaccacatggtctactgcctccaattctctctgtttcttcattagctgcattcaccagcttctcttgagatcaactagttctgcttgtcccttattgtattactggccccaaaatggctgcccctaaatggtggccttggatctgaaattcacatgtccttataaattcaatgcttctgtcagagtgacccagtctctcaatgttctgactctaaattcttaggaggcagagtctgtttgacccagcctaactcagatacagagccagatccaaacagctgggagaacaggatggagaagagttcccatactatcttctcagcactctctaaaaagggctgttggcaattttgcctttttgtaattctatttgagcaagttggaagtttaattagctttccaatcaaccaaatttctgcattcgagtcttaaccatatataagtgttactgtggcttcaaagaaaatatggattctgaagtagtgggttttgattgagttgactgtttttaaataactctttggattttaattgtgatgcagaagttatagtaacaaacatttggttttgtacagacattatttccacgctggtggataagctcaataaaggtcatatcccaaactaaaaaatataaaataaaataaaataaaaaataaaaaaataaaaagggctgttggtcaattttataaaaggcaaagtcaaacagagggaggaatgactgatagatgaaatgactggtctcttggtgcatctgtttctaaaattccgttaactttccagaatgagcctgccaatagctctggtctaaactcaacccctgtgacctccatttcacctccatttgagtcacctgctgaacaagcatgcccttcacactgcttgtattgcctccgtggcttagacttgacagtttctctgccttgtcctctttgtgaacatctactcctcttttcaaaccctgctgggttttatcttatctgtagttctatttctctcccactctgtatccttccaaaataagttagtcacattttccttttcaccatagtactttaattttcatatatactacttatacgattgcatatgtcatattgcattgacttcatagattcttgtaaggtggatgtcatccaattcatctttatacctctaggatctaaaacagcaaagtaggtgctcagcgacagtgtaccagcacactgaataagcatgacttttgagattaacctaaaaccacctaattttcattttccactgtccctttgaaaacacccttcaagggtgtctggttgcaaggctggttcttctcttatccctgaattaaaacttgggtggtcccattactttttctggtcatttttagttaagagatgttaataactaaaatatccagtcctatataacaatcaaaagttggcacctgacttagtttaggcatttctccctcctcccagtttgtgccttctgtagtagatttaacaaaacagtgtggccacttctcttttttcctgacttgtttccttagatcttgcccctcctagtttctgatccctccagggtttgagaggaggatgagcaatacgtcttactttgttggtactaacatgagctgccatcagtttccctgtacctcacaggtattaaagactgattccttatctcaatgggcacttacgtgggtttagggggacaaaactctacttctatgaatttttcaactatagctcctttgaccagctggccacttatctaactccagaaagacctttagcttttccctgctgaagtctattcctctctttgagtggtcatcttggtcaggtccagtgatgactcgctgctggcttctcttgtctttttttttgtaatattagccaggttaatggcggggttttgccatgttgcccagaccggtcttgaactcctgggcttaagcgatccttctgctttggtctcccaaagtgctaggattacaggcgtgagctactgcgcctgactcaaatttaatttcttgtaccccaaaaagaggcagaaagaaagacggactggataccctcatttatagaaccagaaccccatactggtacaatatgaaagtttctgaaaaaggtccaacaggtatttgatatccacaaagcacaaaagacctaattatagttgttttttttgtttttttttttctccaactgggcttaagcccctttctcctttgctttctgagcaaaagtactactggcctccagcagctgaaaaagcccttaagaaactgaagcattacttgtctttggctctagtcctggctcactctaacccataaaaacctttaaagacagagaccaatctgtctagcattcctatcggtcccaggaagattctctgtcactcatgtgtgcctgcttttcaagaaaaggaacccaattaaagacaggtaacttcatgtggcaaaagatattcttggccattatcactaccttttttgtcttatattcaataactaaagtagtatggtgatttcaacttctgagttatttataaacctagaaaccagaattgtcctactagcaagtaacttgtctcttagaagctgaaattgctgaccatgccacttgtattccaagtgattctgtgttccctgaaaggctacaaagacaggcttgaacctcacctttctcatctgttaataataacaaaaccacttgtgtggtcagagctgccacatcaaccctgataggctaccggaaaacacttcattatcaatgccctgctgcacatgcattcccatgtacagcagcctctcattggaaaagaacacacatttcaatcatgccttgatgccctccccaaccaatgaggtattgcaggttgtaaagatccgccccaacccactactgccatcagccctgctgatggcccaagattcaccatgtgtaatgcaataaagacatcattatctgtgttgcctgtgctagatcaaaagaccagcttgggagactgacactcttctatctctacagctaagcctgtgtatcctggcaattatactaatggctttatcaatgacctttcccaaattagtacgttaaccccattcttatcacagtggccttcctcctgaatagagctcatgatgccctacttatctgcctgtctcaagctctaaacttcattcctccaaacgtgttttccaaaacggagtcttgctctatcacctaggctggagtgcagtggcacgatctcggctgaccgcaacctctgcctcctgggtttaagcaattctcctgcctcagcctccggagtagttgggattacaagcgcgtgccaccacacccagctaatttttgtatttttagtagagatggggtttcaccatgttggccaggctggtctcaagctcctgacctcgtgatccccccgcctccgcctcccaaagtgctgggattacagacgtgagccaccgtgcctggccctagagggaactcttaaagcagtggctctcaacctttgttgcaaaatggagggttttaagaaagtactgatgtctgggctccactcgcagagattctgatttaattggtatagagaaaagccagggcattaggatttttttaagctcccaaggtgattctaatgtgtgggcatggtagagtacctgtcttttttttttttttttttttttttttttgagacggagtctcgctctgtcgcccaggctggagtgcagtggcgtgatctcggttcactgcaagctctgcctcccgggttcacgccattctcctgcctcagcctctggagtagctgggtctacaggtgcccaccaccacgcccggctaattttttgtatttttttttttttagtagagacggggtttcaccgtatttgccaggatggtctcgatctcctgacgttgtgatccgaccgcctcagcctcccaaagtgctgagattacaggcgtgagctaccgcgcctgacccggtagagtacctgtcttaaagctccctaaatacagacggacctacgatgcacagagcatccacaattcaactgataggtggcatgtactttacactaagttctatgctacctcattttgtcattacaataatcctatggcacaggcactattatccttattttataaattgagaaactgagattcagacaggacacacagagtgactggcagaccctaaagtcaaagcccaggtctgattcccaattgtacacactttatatgacatcatatcgagatgtcatgcctctcagagctggatgatcccactccctaaaacaagacacccaggcttcaaccctgaaatcctattccattgcctccatggatttttcctgcagcattttcctatgcacttcacacatacagcgcagctgccaggatatactttaggctgccaaaatgaaatgaagtcactttcttggtaagtgattaccatgcctggctctttactgaagtacttccattctatatattcacactgggatccttctccatcactgctagcttcaatcctgtggctttccatatttagtttttcttacagatgaagtgatactctttacctatcagccattcctttgttggagtaaaattacgtattccatcagcattcttctgccttgtactccagatagtatacaaagaatcaaattatagtagctaagtggcatagaattgctgccgatatcaagatggactctaatatctagtgaactgggaggctagaggctagaagtatgtacttctgtaaggtgtcagtgacacatctgagtaatgtggtagctaaatgccaccatttcattccatgaaatccacatttcattctggctaaagggtaaagctggtgagaggtgggaggggccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcaggactgtggcttttagaatcttcctcattccattccattaggggcgtcccgatttccaccttatatacaccatgtactaaatgcatgccatttctgcctgtttacaaacatgcataagttcacactcttttaagaaaaatgtcctctactgtcaacttctttctagtctggcctcccaggtaggctacagagctactgccttcatttatctctcaaatcttcccatcttctccttcccactgtattaccttagctcacactcacatcctcttggtcaccagccaaaaaataaataaaactcctttgtcccttcagatttctctcttattctacaacctcattaatcggctctcccgctcccactcctttactacttcagtcgctgaaacctcccctcacagagttcacggccaatataaaaacggaaagaagggatgaccatacgagcttgtggacttttgcctgcaaaatctcatagaatgtggtgttgtgtacgtgaatccatcagatcaacgcgacggacactccccaagggccaaatcggaccgcctctcactaggcggaaagttttgaaacttttgcgcgctaaaaatgatgagccagacgcatgcgcaaacgtgcactcccggggtggcgcttctcctcaggcagatctcgcgtggtttggtgatggccggctagtatgaaggttttccgtggcgttgagatcccacccgcccttttttttttttttttttttttttttttttttttttgctgccccagtggattaggattagtgctgcagtcaaatgaaaaagatcaagacaaaaaattaggctaatataactagccgacaggctagcggcatttctctggggccgaggaattccacgaagaagatctctgcgaggcccagaaggccgcacaactacttcttcagaaacaaaattttttaaaaaagtaaaaatagaggaagtcagccagtttatcaccttggaaccagcgttttgtttggcttttccgcttttcactctacgaaaaagcccattggcggctacccaggttaccgtcctgttgccattgcgcctgcgcggcggtttgtttaccagtccaggcgaagcgctgtgtcgcggttctcgccgccccgagcgccttggtttgctcccttgacgtgtaattcgtaatgaaagtcatgttttcatttgggaacacggatcggaggtttaaaactggacagtttaagtgtcaacttcagaccaaagaaaataatggtagggaaaacactggacactcagaaatcggtgccgcgtcagagctgtcacggaagatgtttctaatgaacctgaggaaaacaatagcaccaccctaaccagaactaaaaagtggcaagcagccacagttaatgaaactcataggtggcatttagttacttatttagaatgtaggcctagttatggtaaaaatgcaaataagaccaaacctaaggtcctcttgctcgagcaaacctcaagcaaaacctacatgatttaagactgactcttgaagcgaagtaaaaaaaaaaaaaaaaaaaaaaaagcagccatgcaaaatttgaaacttggagacgactctagaagcattaacccaagaaagcacaagccaacaaacaaatttttgaaatggtttgaagagctcttcaaagtcagtttcaggtggcttagaagaggatgttgcttataaaatgagatctgatggaaacttgttttacagatatgactggattcgtttgaaaacaaaaaaaaaggcaggcaaagtgactttttaaaaagtatttttatggaaggatttctaatgatacattttaatgtgctcaaaaaacaaccttaaataactggtagattcagccaaacctggatcattgttatcttagagctggataagagcataaatgttaacaatttggcaattttattggactctgttatgtttttgaatggtgaatttgaagacttcaacttgtaacaagaaattttctaaaaggaaagtgggattttcaagacatatgaaattaagcagagaatatgtatggacatgtgaacagatggaaccaaattttgaaagctttgcatgtgtccagcatcggtcacagaaaatccttttatctcaagaaactagcctctggattttctcacgttcaatatgataaaactcagtaaatccagcagcttgaataccttttaacacaaatttgtaccaaaatgagaagtaactttaaaattccgctccattatctagaggtactctgacttggttaaggtaaggtgaaaatcggttttccaagccagtattgaactggcattttcatcatgaagaaaaaaaaaatgcagataaagtgaatgggtatcttgttcactttaatgattaagactaactcagaaagctggcttactttgtcaaggcaaacaaccagtattaaacaaactgaatactctcattgcacataatgagaaggcttgaatgaaaattaagtatgggagtggaagagctgataaagaacagtgacttctttgagactcctagttcatttacatgtgatgaaaattatagtgtaagaatagtaagttgtcaaataaaacatttttcttcactgaaaaaaaatctttggtgagtaacagaaactgactgatggattggtaatttagtctgccccgtgactcagaaaatatacttaccaaaatttccactgtcagtagctgaaaaagttaatcatgccatttctttagccagtattctgggcatactcccctgtgattactctgatactgtaaagtaatgaaaaacctgatgccatctgtatccacatatttatgtgaatctgagttctcgaattattgtgaccccaggacaaatgaaagaaattgccaaataatgaatctgatatgcatccccaattactcaaacttggttaaagcaacacaatttaaccttattaactgaatgataggacatttttttcatgatcgataacttaaagcattttttttttctcaagacggtcttgctctgtcacccagtctagagtgccatggcttgatctcggctcactgtgacctccacctcccgggttcaagcgattctcttgcctcagcctcccgagtagctgggattacaggtgcgtgccaccacgcccggctaattttttgtatttttagtacagacggggtttcaccatgttggccaggctagtctcaaattcctgacctcgtgatccgccagctttggcctcccaaagtgctgggattacaggcatgagccactgtgcccagcccattttatatagcattctacagtcactcctaactaatacatagggaacagtttgggagatagggaatagggaagatgaaaaatttggtttatcacagtcagtatgagcattgaaattagcttaatctccagggaaaagaaagaatgaatttggccaggcacagtggctcacgcctgtaatctcagcactttgggaggttgcagtgggtggatcatgaggtcaggagtttgagaccagcctggccaacatggtgaaaccctgtctctactaaaaatacaaaaaattagccgggcgtggtggtgcacacctgtaatcccagctactcgggaggctgaggcaggagaatcacttgaacctgggaggtggaggttgcagtgagccgagatcgtgccacagcactccagcctgggcaacagagcaagactctgtctcaagaaaaaaaaattgaaaacatacatattagggccaaattgcagggtttgtgtatgaatccctaataagccaaataaattttgcttacttttagctctgcactcaggtcttaagtattgggggtaattcagtactcttgtcatacctaaagaaaggatgtttctgctggcacaggcccatgcctatagtcccagctacccaggaggctgaggcaggaatatcccttgagcccaagagttcaagtccagcctggacaatatagcaagatcccatcactaaaacagtgtttcaatcagagggaagagaatcttcagcacgagaggggaaaagggagaaagaagggcaaatttggtttgtgactggtcaaataatgcccactgaggacaggaagcagatgcactctacttcctgctagggaactctgcccttgcctccatctactggcatgtttgcatggctgacttcattccatttacatctctgataaggagagatacctttatggtctgttatcttcaatgtattaaagagtctattatcatagtcacaagatagctgccgcagttccaaacatcatgttctcatatgaaatgtttcaaatagaaaagagagtatgagccaaaaaaagctttctttctttttttttttttttgtaaagatggggtctcctcatgttgctcctgctggtcttgaacacctggcctcaagcgatcctcccacatcggctttccaaagtgctgagattacaggtatgagccactgcacctggccaaaagctttctccttgaggcctctctcttcttttttctctctctttctttctctctctctctgtccctttattttttattttttattttttttgagacagagtctcactctgttgcccaggttggagtgcaatggcatgattatggctcaatgcagccttgacttcttgggcccaagtgattcttccacctcagcctcccaagaagctggaatcacaggcatgcaccaccacacctggctatttgttgttgttgttgttttgttagactctctcataagggcaaaaaatgtttcccatatgatgttgcagacttccctttatttcttactgcccagaactatgtcatatgactacctttagcttcaagggaggcttagggaagtatgtacagagaaaacaagcatgtttttttaatggtgcactaaaaataacaggacttgtgggaaatatagggttagaagcaggtcactcaaaacctttgcaactttgttagttgagggctataaaaattactatgctaataaaaaatacacaattaaattccctctgacacttgtactcaatatcacagtcatcctttagggccatgctgtccaatacagtagtaactagccatctgtgtttattgaacacttagatgtgatagtccaaattgagaagggctgttaagtataaaatatacacataagattttaagaatttagtataaaaaataatgtaaaaatctcaataaattttatattgattacatgttgaaatgtcacttcaacatttctttttacttttactttttaaaaatgtggctcccagaaaacctaaattgtcgaatgtttctgttggacagtgctgctttagtttcttgaatcctggggcacatgattcttccttggatgtatatgcccttgagggtattaattccaattaagagcagtttcatcaaaattaaaaatccgatcgaggattttgtcttttttatcaatcagttttcccccaatggggtaaaatggttttgcaccttcatttacactttgcagtttaccacagaacttaatgttgtaaaaaactcttgaagccaccaaacaagcctctgtttgcaccaaaggaaggcattcttgcagaattttctgctttttttcttaacatctttatatgttgctaaggttttctctttaattgtgagaagcttgtccctgcttgccccaaaatgttagtgtgctgggaaaaataatgaatgaagcaatgtaatttctgaattatattaacattatctccccatttgttgcttgcccattagctaataatgactatatctggcatataaagcttttattgtgggagataggactgccagtagacaaaagggagagaaaatcctaatcctataatttcaaagagttggtacccaattatgggatattttggacagtgtcctttctattcaccaagttaacatttagttaatcgccccatttgatttactcaattacccctttctcccagctaaaatccattgagttctaaagaaccatttcaaaggccaggccaggtggctcatgcctgtaattccagcactgtgggaggccaaggcaggaggtttgcttgactccaggagtttgagagcagcctgagcaacatggcgaaatcctggctctacaaaatatgaaaactttagctgggtgtggtggtgcgtgcctgtcatcctagctgcttgggagcctgaggtggcagaattgcttgagcctgaagaggtcatggcataatcatggcattgcactccagcctggtgacagagtgagaccctgtctcaaaaaaaaaaaaaaaaaaaaagaatggacaaaggctgtctcttcagtaaatcttttcctgatctctcctataagcattttgcttgcatcatctttttatagaacacatatttggccttatgtttatgttattgtctgatttttatatgtagaataatatttttaatttgcatatgtagaataaagctcctcccactgaagacagtgattgtattttattcacttttcaaaattcctctgatgactagccttatggtttgtacaaattaggcacaactaaatatttgttgaatttaattgtgctgtatcctaaaataatagaatactaatagaatagaatagaataaataatataatatttctaaaatattaatagaatcttattctattaggaatagaataacagattagatagaatatttctaaaattctaaatacaagttggtatttgactcacatctctagtgctttaaaaaagtgcaacagaatactctgtaaaatagtgttacaaagtcaggctaaacatgttagagtatgtactggtgggttttttaaaaaattagtttcagtaattatgattaaatccatggtaaatatagacctgtgataaatctagatccttacggtgatgactcattttaaaagaccctagttttctggatctccattctccttttactcagtgccttctcgttttttttctctattttaaaccagttttcattatttctctgctttgagaatcactcaaaacaaaccagtaagggatgttcaacttaaatctaaaacatcatagtcacatttaaagtcctgagaacgcagcattcctgttaaataatggtcataatgaacttattaatcctggccctctaattacactattctacaccccagtgataaaggtgttaaaaaatgatgatttaattttgttctggtcttttcacttggatgtaccgtatactgacatgaatctcatcatgactgataaactgaacttggatagaagagctgttaggatgacttaagtgcaaaagagaatctaccgtttaggcaatcagtatacagtttccttaaattttctataatttatttcctttttttgtatgatgttccagcttttcccacagagctaggagccccacaaaaatagagactttgtcttatttgtttctggtgcttgtttgtctctgtaactctagcactcagcacaatgcctgacacattgtaggtaataaaggatacatattgagtgaatgaagtacacctggggtcaagtatcacatgttccaaatgagcttggctgaggttagattacccttatattggacgtggaaaggatctattacctaatttcaacttgcctctatgtctgtggcattggtggttgggtaaggtctattgattgtgagacacagtctcactttttaccacaagtagtatatggagtatgcgtgagtgcgtgttcgtgtgtgtaacaggaatcttagccataggacatgaaaagccaaactatgggaccttgaaaggttcgcaggtaaatggtaatcaaagattcccaaggtctgtgaattctagacatctttgccatagaagcctatggcccctcgctctagcacatagtgattctgctggtccctacatgtcttctcaatgcacctgtctgttttcttcttactgtacttcctagttcttactgtacttcctagttctagttcttggcttagctaataaccattttctttcttttgggtagagcagtctgtaccaggccccatcataaaccatagtgctgagttaggagcccaagccagtggcttggagttggagtacttttctcttggaaggggctatagactgtataagttgcatgactgccatgtctaggattcctaataccgtgcactgggagccatctctgggatcttcactagaaccaggtgtacttgccaatcatatctactgggtgctaattacctactttgcggttattttgtttagagcattagattagcttcattggaggatacaaaaaagattaaagactaaatagatttatatctgaagtcaaagtgagtaagtcatagagacagtgtatgtgttggtgtgtatgtggcgggggaagcactttctgaaagagctatgtgtagtggaaaaggatcaagtttaggttgttatcttgactttgcaaccaatcgtgtgtgactatagagaagtcacctttgatcttttgttctacttcacttgttaagggttgtaatacttaacttgactgtatagacaactgttaaaacactatcataaggccaggcgctgtggctcacacctgtaatcccagcactttgggaggctgagatgggcggatcacttgtggtcaggagtttgaggccagcctggccaacattgtgaaaccctgcctctactaaaaatacaaaagctagctgggtgtggtagtacaggtctgtaatcccagctactcaggaggctgaggcagtagaatcgcttgaacccaagaggcagaggttacagtgagccgagatcgtgccactgcactccagcctgggcaacagagcgagactctgtctcagaaaaataaaaacaaaaaatactatcataaaataattgttaaattcagattattgtgtgagtagtgtatgaaaatgatataaaaatgttgaataggtagaatctatgcaaatttagagttcaattaaatttggtggggattaaaactcttgtgtatgcatttagaaaagcagattataaatacagttgtggtttggaatagttgcaggattagggctgacagttctggccttgtgctgccctcctgtgctgtttaaacagcacagcaggtcaattacattcctgcttcatgaatgttccgaattgggggagggtagtctatctcattactaatcctcttctgtcctcctgtggccacagagcgcctaactattttggatgtttctgtttcttcagtaaaggaagggaaggaaaactacttggaaacattctaggtcaaacaatcttatcctgagttatggaaaaaggcaactaattgcaaattgcatttgacattggagatataattgatacaccaatatagaagatccgagcagattatcgaggtttggagaaaaacaccatcattacagcattgggaaaggctttttgtcaagaataaatagaaatgcatcttttttttttttttttgagacggagtcttgctctctaacccaggctggagtgcagtggtgcgatcttggcccatgcctgtaatcccagctactcgggaggttgaggcaggagaatcacttgaacttgggaggcggaggttacagtgagctgagatcgtgctattgcactccagcctggtcaacaagagcgaaactccatctcagaaaaaaaaaattgctgagaatttataataaagccatacactgtttatctggttaataagatagtctattatggtgggaacagaagatgctgttctacagtgattttctaagcagaacatttgccagttgaaatgagagactcacaagcaaagctaattatttgctaattctcttagcatatcctgcaaaaatggttacttttaaagataaggtcatttgtcagcatggcaatttttttttttttgagacaggatctcgctctgttgcccaggctgaaaagtgcagtggcatgtttacagctcactgcagccttgaactcctgggttcaagagatcctctcacctcagcctccccagtagctgggactacaggcatacaccaccacacacccagctgatttttgtgttttttgtagacacagggtttcactatgttgcccaggctggtcttgaactcctgggctcaagtgattcttcagcctccacctcccaaattgctgggattagaaacatgagccaccaagcctggccagtatgataatttttttatgacagttaagaaaagatattgaaggaaacagtgtaaaaccaggcaatgaaagagtagagaaaggcagtcaatatatggcaccattttaatatgcttgcttccccgtcagccagccctcacccctggccacagcctggcctgttgccagactggtttcctgatcagaacccatctaccctctgcttagactaggagtgtgtgtgcataatttattcatgtgggtacacagcatgcataacatgactttctctttttaactcacaccagtcaggctttcacatctttaccaagactcctcttatcaagtcatcagtgaacttgatggccaaatgcaatggtcagttttcagtgtttatcttacttgacctatcagtggcattggaatcatttgatcatgctttcctccttggaacactctctttacttgatccctgggtcacctctctcttggctctcctccactctactaagggctttttccctatctcctttatctagatacttctcatcttgatttctaaaagttgtagtaccctaaggctaactgcctagctcttttctacatctaaacccactcccttggtgttcttatctagtctcatagctttaatatcatctgaatgccaaacatttccaaatgtgtatctccagcacagacccttctgccctgaattccaaactcacatatccatctgcttactcgacatctccatttggatgtctatggacatctcaaacttaacatgacccaaacaaaatctgttcatctctcaatcaaccctatctcagcaactggtcatacctttcttcagttgcttggagtcatcatgaactctttctcacacacacagaccatttccaaatcttcagcaaatcccattggctgtatcttcaaaaaacacactatcaactctctacccttcttttcatgtacactgctaccaccctggtctgaggcccatgacctcttatctggattagtgtatagtctactataatacatggtctccctacttctctcttgcctctttgaaatacttcttactcagcaaagtgacaaaagttacccgaagtcaggtaaaaaaactctatgctcaaggatgatgcacttcaattggcataaaatccagcctttaccatggcttataaagtttacatgattggggtctctacttccttcttctctgacttcatctcctactccccagcccccactcaccatgtttccagcttactagttcccttattgtccctcaactatcccagacacattcctacctcagagcctctggatttgctatttcctgtgcctgcaacacaaaattacatggtccatgctctcattccattcaggattctactcaaatatcactttattgaaaagtccttccttgttcatacagcatctgccttcattaccctccgtactcttaattagttgatttgtcgtgttagcacttacagcaacatgacatattatgcttatttatttgtccattgtctgtcttccacacttgagtgtaagttctgtttcatgacagcagggactttggctatctttgttctctgctgtgtcctcagagagtctggcatctggtgagggttcattaaaaatttaatgaatgaagaaatgaacaaatattaatgtggataattattcagagagttggtcaagaacagcaagtgggtaggttccagttttgttttacatggaagtttgtataaactgaagactaagatcagaatcagggaaaatgttctcctttatgtcttctcaatgtaaaaaatagaatgtagttgaatgtggtggattggtaataaatatgtttattgttccaaattccatattttatttatttatttttttagggacagggtctcgctctgtcgcccaggctggagtgcagtggtgccatcatagctcactgcggggtcaaactcctggcctcaagcgatcttcccaccttggcctctcgaagtgctggcattacaggcatgagtcactgcgccgagcccaaattctgtattttagtagtagaagttgtccacttatgttttaaccatggaaattaaattatgtgtgtgatcatgaatccaaattttgctatttatttcctattcttttttttttttttttttttttttttttgagatacggcctagctctgtcgcccaggctggagtgcagtggcgtgatcacagctcactacagcctcaacctccctggctcaagcgatactcccacctcagcctcctgagtagctgagactccaagcatgtgccaccatgcccagctaatttttaaattttttgtagagatggggtctcgctatttgcccaggctggtctcaaacttctgggctcaaaccatcctcccacctcggcctatttcctatccttatggtcctggcaatgctggtaaacttgcattagttcattacattttacttggaaatgaaaattttcatctaagtaaaatgcctgatgcattttttttctttaaattctgaccccactagattagttttaaacccttcttgaatctaattttttcaaagatgccatttttccaggcatttgaatcccattttccccagagcctttgttttgtgaatagtgcattctaagtaaattaaaccaatgaagccttagtgatataattgcaaacctatccagtcactgcatcttctacaatggattctggactcagcttaagtaggactaataagtacactagtcctagtgccttctctgctctcttttgtggctttggaacactcagttctctatttcagagcttcatctgcaagagtggataatagcatttgcctcacaattgtggtcttatgaggatcaaatgtgatgacaccagggaacctgctttaaagtatttaaagtggctgggcacggtggctcacgcctgtaatcccagcactttgggaagccaaggctggtggatcacgaggttaggagttcaagaccagcctggccaagatggtgaaaccccatctctactaagaatacaaaaattagctgggcgtggtggcacacacctgtaatcccagctacttgggagactgaggcagagaactgcttgaacccaggagagggagaagttgcagtgagccaagatcacgccactgcactccagactgggtgacagagcaagactccgtctaaaaaaaaaaaaaaaaattaaagtattacgttaattagggatgacttgggttcaaccaacagaaactcataacaagctagcttggagcaaagggggggaaattactttataaacacagtgctatagaacgtaaatgtagggagtagtacctcatgaactaatagaacgtaaatgtagggagtagcacctcatgagctaatagaacgtaaatatagggagtagtacctcatgagcttcaggatccggaaactgaagagtctttggttgctcggggctgtctgtcttcctaaaactatgtggtctctcttctctgccccctttgcacatttttttctttcttctgacactctgcagacagacattatctgcatcttcatcacacatgggctgaagatagtgtccttttgtttttgagacagggtctcactctgttgcccaagctggagtgcagtggcatgaacagggctcactgcagcttcgatctcctgggctcaagggatcctccacctccacctgtcgtgtagctgggatcacaggcacatgccaccacacctggttaactttttaaattttttgtagagacggatcttactttgttgcccaggctggtcttgaactctaggatcaagcagtcctcccacctcaacctcccaaagtgttgggattatgggcatgagccaccgtaccccactgaagacagtgttcttaaaagggtactttcaatctcaagtctacattacctcattagtctctgccttacaatttactaattgaagtttctcagacttgattccaaattttcgggagaaaaaatttggctagccaagtttaggtcaaacaaccacctcctctccccttgtctgatcaacttcggtaagggaatgggaacagggtttcataatctgctgtccccccagcagaggttatgggaacagagtctgagaagggagtacaggacaacagagaaacaatgagtgttgcacacctcaagtgtgatgtgaaagaattaagaataccacatgcagccaggtgcggtggctcacacctgtaatcccagcaactggggaggccgaggtgggtggatcacctgaggtcaggagttcgagaccagcctggctaacatggtgaaacctcgtttctactaaaaatacaaaaaattagctgggcctggtggcgcgcacctctaatcccagctacttgggaggctgaggcaggagaatcgtttgaacctgggaggtggaggttgcagtgagccaagatcgtgccattacactccagcttgggcaacaagaatggagctccatctccaaaaaaaaaaaaaaaataccacatgcatccttattcctgtacccgtgtaactgttaatctactcaggatccaacctggccatatgattaatggcacatttgtaaatatggataggtgtcagagagccccaccaatcataacatcccttcacattttgtgtcagatgcttgtctccagtattgtctcttttgccctctttttattttcgttacagacagagtctccctctgttgcccaggctggagtgcagtggtacactataacattgaactcctgggctcaaatggtccttctgtctcagccccccaagtagctgggactacaagtgcacaacactgtgcccagctgttttttaaaaaatttttttgtagagacagggtcttgctatgtaggccaggctggtcttgaattcctggcctcaagtaatcctcctgactcaacctaccaaagtgaggggattacaaacatgagccactgtgcctggccttctgtagccctcttaagggacataccttttcattctttcttttccctggggattaagttaatttcaatgctcatactgaccattgagtgataaaccaaattcttcaccttccctattccctatctcccaaactgttccatatgcattagttaggagtgactgtaaaatgctataaaaagtgggccggtgtggtagctcatgcctgtaatcccagcactttgggaggctgaggcaggcagatcaggatattgagaccatcctggccaacatggtgaaacctcgtctctactgaaaatacaaacattagctgggtgtggtggcacgtgcctgcaatcccagctactcgggaggctgaggcaggagaattacttgaacctgggaggtggaggttgcagtgagctgagatcacgccattgcactccagcctggcgacagaatgagactccatcaaaaaaaaaaaaaaaaaagaccccaaaatgaaaacttatttcttctcccaaatcaggtcagggacccaagttgaaggtggctctgtcatcttcaacatgtggcttccaaggttgctctagtattcacctttccagcccatgagaaaggggaaagagagtggcggattctgagggggtcacatgacaggttctatgcactaggcctggaagacacataccacctttgcttacattctattggaaaatacttcatcataaagccacacctaattgcaaaggagacaggggaatttcatgttgctgggcagttgtatgctcagttataattctgctactgggaaagaaggcaacaatggattttgatggactggatccatcagtcgcttgagagactgaggcaggaggataacttgagcccaagagttcaaggttatagtctctcctacattctccttttctgttacctctcttagttaatggcattattctctcaaatacccaagcttgagtccttaaattcgtcctccctttctccatctctctcaatcctcttatatgttccagctacctaagtaaccaccctgcatttgttccttgctttccatttcctctatagcatgacttaaatccattgtatctgttgattgaataactcatcatcctccaaaattacctccgtgtcagtctctccaggctcatcacacccatcctttactctgccgtcagacactacttccaaacacaaagatctgcttgtccaagacagcctgggcccattaacaggcacctccccactcacagtcaaggctggaagcaccatataaaaagcatctgcagctacacctttgcggctcaggagattatggcagactgcctcctttctctgccaagccctgtcctcctgggctcagggttctctgtctcacacttgaactctgcccatctccccacatcccactggatgaacaccacagtgggactgtctgcccagcttttcatttagccctgtccctagacactgtctgtcatatcaccctcagccccatctcacaaatccaaactccagagctccaacccaggcccagggcccaggcttgcttttgttcaggagacaagtttggacgctgatcattctcttcacttaaagctccatcagttcgcagtacttacggagcaacagattttttagcatgccatccatggccaaccactgtctgatcccatccccacttaccacccctaccaattcatcctcataatcatcttgacattttcttattcttcaagatctgactcatatatcacttcttccatgaggccttcctctttctccttgctttgtacttcatagcatcatgtttttctatgtattgctttctacctctagtttatttatttgagacaatgtcttgctctatcacccaggctggagtgcaatggcatgatcatagctcactgcagcctcgacctgggctcaagtgatcctcccacctctgctttctgagttgctggggctacaggtgcaggccaccaggcctggttccaacctctagtttttgtgcacatggtatatactccccacaggcaaggactctgacaaatatttcttcacttcccacattgctgagaataatgccttggacaataccttacacatggtattgatcactgcttaaaacctcctaatgccccaatggctttccatatcgccaggccaataataaaagccctacctatgcctacctggtcctatctgatctgatgcgctttttttttttttttttttttttaagacagagtctcactctgtctctcccgggctggagtgcagtggcacgatcttggctcactataacctccgcctcccaggttcaagcaattctcctgcctcagccttccgactagctgggatcacaggcgtgtgccaccatgtccagctaatttttgtattattagtagagacagggtttcaccatgttggccaggctggtcttgaactcctgacctcaagtgatccacccaccttggccttccaaagtgctaggattataggcgtgagcaccgtgcccagccctgatgctcctgttaccactccccacttgctccgccctatccaccatgggcccccctgctgttccttgaacacattaggcaagatcccacctcagagacacttcatttgctctttccccagatagctgtatggctgctctctcatgtcttcagggcttctctcaaaggccaccttttttgtgtgtgtgagatggagtctcactctgtcttccaggctggtgtgcagtggcaagatcttggctcactgcaacctccgcctcctgtgttcaagtcattatcctgcctcagcctcctgagtagctgggattacaggcctgcactaccatgcccagctaatgtttgtatttgtagtagagatgagtttcatcatgttggccaggctggtcttgaactcctgacatcaagtgatccacctgcctctgcctcccaaagtgctgggattacaggtgtgagccactgcacctggcctcaaaggccactttctccatgaggccttccctgaccacttattcacattgtgatccttgaaacacttccttttccctctccgcttattgtttctccatagcatttttcacctccttacatagtatgtacttctttcatgtgctgtgttcattttctgtctcctctcccctttttggaatgtcagcatcattctagtttaaatctgtttgtttacttctgtgttcccagagcctaaggataatgtctggcatagaggaggcactcaataaatatttgttgaaagaaagaaggaataagcaaattaatagaaggtgctccgtaaatatttgtgaaattgaattaaaagtgtcagaaggagatgactgtgaaattcccaaagtctaaaaatatgtgagcttagaagaatggtggagttgagtgctgcctcattataaacatcctcgaggaaggactgaaactgtgtgcttgcggtgggaggggcagctgggcaaggaaccgtgaaccttcgcagaaacatttggggctgcagaacttgggtgagagcgctgcatctgggagctggcgacgctggcggcttgctcattcaccccatctgaacacttgtctatgacacaggtgttttctcttaagttattttggtctttgcctctctcctcaggttgtgaagattacagaaatctgggatggcttatgggacgcttctcagccctaagtaggaaaacagcagtgaaaatggcaaccaaaacatcacgcaggactgggggttttggggaaacagctcactttagagcagtgcagtgtagagctttccgtcttttaccagggtccacctttaacactgtttatctgaaaattttccccctggcttactcgcttgcagctgcccactttgcagaaggatggcgctctgatctctacgctccctgttccttcagggactccatagtattttttttcacgcgtcgtcgctactacagcagacgcctgcgttctcattatttgctgtacagatctccggtgccttgactgtaaacaaaacactttagatcattgtgaggtcgatgtaagcacagcctttctgctggcagccagacttcttaaggtggtgtgactgtgacttgcttacttttcgagatcaacaacaacaaagcgacaaaatggtgctcctacatattagttgaaagattcagcatgtgaaggggatcgaagtgtttattttccacttccatataagacatgaattccatgagtaaaatcaaacttctgtggcaaggtgaactactctagaatgtctccatttacatacatgtggtagtttgggtgtttatgcatatggatagatgcacatatatagagttcctgtgttgtctagcaattgttttaaaatttggacaattatctaatttctagggtaaggtataaattatggtagggaggcctaccctaattttcctgttccttttcccccagtctgcagtccaataaattgacagccttaaaagtagaaaaactaaagaggatgagacctcttgcttgatcctaggtgaattcttttctgtcagttaggtaggaagtcctgacttgaaaactagttctgggcactgccccctttactgttctctgggtatcaacccctgtccttcaattttagttgaactagtggatggtgataccacaggctcaagacagctgcatttaaatatcagtgaccacaggccacatcaaggaaacatctgcaggcaacccagggcctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagttttttgttttttttttttaatcttgagttcctttcttattttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagcccccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaatattgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcctactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaaacaaggtatttgacctggcattctagtcatatttacacaaatgtaaatgtgaagtggcaaatacctaggtaattcaggcccacaactcagatgatgttttatgtagtccgaatgtagttagcagttactgttttccacttagctctgtgtgggaggacaaaactttagaaggtgaaaatggaaaagctacattttcatatgaataaggttgtcaaaagtctgcattagtaaaaatatttatgtcttctaggatatgaatgtgtcaaaaccaaagaatccttacataagtgtacactgacacatttgcaggattgaaaatgaaagtaacatggtgacttctctaaattctgtatttacacatgagaagtgtgaggaattaaagcaattgtttggaccatctaatgtataaatcttgtttaaaatattcaaacatatgggcccttaagaaattggtgtgcactctacgtagctatttttgaaatttaactggtcatacaaaaattctttcaatttctatatttagaaacggggtatttccttgttataatctacacaaccaaaaactggctaatgtaagtaaccaaatctgaggattttgagtctccatagccatacagcagatatacagtttttacctaaggaaaaaagtataagacaagacattttaaagtcagattactaaaatgattcctgtaattccacattctcaagaaaaaatgtgtttaaggtgtaatagtaaattcttataggacttattctagtaagtgggtaaatcgtaaaaatctaaatttgggttaaattttttcgctcaaatacctacatttcctttatcgtaccccaaaaggagctctcaaagagtagtttgaacagtttttgacccgaagattttttttttttttttttttttttgagcaggttggactcttcggcttcctggaagggaaaaataggtcctttagtggctgggctacatctttcaagtaggtattattttaatgaaagactagaggtgttttgtgattttgtttgaaactcgcatccaagagtgtttttcgaaaacagactgaaggagcaagaaaaacaattcgaaataggaaggagaggagggtcagaaaataatgaaattaaagttcctctgagtaaaaaaagataattcagaaagtgtctctaacagaataaaaaatatcgcctggattgctgcaggcaccccagtctcctttcctaaagaggtctctttaaacagaattttgagagattgcgttttagttatgcgggccagggagaagtggatgctcgccgcgccaggcacgtccacaggaacgcagccccgagtcaccgtgtccttcgtcctttacccgcctgtgtcaagcctcccaaaatgacccgcagttcagctcgtccttcgccgtgaacgtccctttgcggggttgcggccgccgtcgcccgccaccccttgccccactacccaagccactgcgccgtcgtctccccaaactgccccgcagttccgcgcccgcccgccgcggcagttgcggggtcgggctggctggtgcctcgggacgagaaggccatcaagtgttgctccctcatctgtaacgtgcagccccccgcactgtcgccgtcgtcgcgcgcagttcccgcgcccgggcggccgcgcctccgccgcgcagccgggctgggcggtttctcagaaactttcctccctcctcctctcctctgcgctgagaaagcagcgaaagctcccactcctctccgcaaacggactctccacctgagtaaccggccgcctccccggccgtggggatatcggagctaaggggagagccttcccgagttcgccgaccctccggcgctgcagcccgctcccacccctaccctgggctccaatgatccgcagccccgcgcatttcgaaagcccgcccggctcgccggcgcctggggagggccacggcggcgcgcagcccgggccccgcaccacggccgcccgcgtgggtcccctctgccctcacccccgctcggcaacgtgcccccatcgcaaccccggccgcccggcgcgggggcctgggacggggaagaactggggaaatgtgggtttgggggcgtgtttgggggactccgggagcgtgggcttcacaggcgaggagcggggcgagaggcctctcaggccggggtgcgcccaccgccccggcctcagggagcgactttcccggaggccgggggacgctgccttcgccatttcatcttcatcatcacagcgcccacacttgctcttctctcaagctctttgcacagaaaaagtgattctaaatctcctctaggatctcctgtctggtgttcagagtatgaatttctttttaaaacttgctgtgtctttcacctgggccacaccctacgcccacccaccccctctcagccaaaagggaggtaaaaaatcctgcgggcccagctgggggtggggaaggggcccacagtcccgctggaaaacctcagcggccacctcccggatccgggctggcctggggactggggtgggatggggtggggtccgcctcaggccgaccccgcagaaccgaaagtgccgagttgacacgtaaggcccagcccctctgcggccgcccgcgcgcccggcctgtcacgcgtggggacactgagcagcaggcatcggagcgagcagtacaaaaagaaatcaaggcgttgggcgcgaaacctcgacgcgcctctaaaggaacgttgagaaaaggcagggagcagggcgcgcggccgggggattgcatcattgcggctccccctccagaaaacgggccccgaaccgcggcgaccatcatggcgctcgcgccgggctgcgctccccgcgcgcctgccccgcgctccggccgcggccccggagcctcggacgcgcatttcacaaacattctcgccctctcccgagcgcccgcccccaccccctccttctttctgtgtgtgtgtgcgtacgtgtgtgcgtgtgtgcgcgcgcgtatttgtgtgtagggagaacttgcagatgattttttttttccctcccgtgctgctggttgtaaacttgattggcattggctgcgcccactgaccccgacgctgagtccgctgaagatttaaggtggatccgagaagctgcagcttcaggcggagtctcgcgctctagtcggttttgggaagagaaaaaaaaaaaaaaaagccccgaaccgggcgcccgccgcgtttgccgaatctcccgcggccccagcccccgcgcccgcccggggcccctccccgcctcgcgcgccgcgcgcggcctccgcccacctcccacttcttccccattggccggcgcgtgcagtttgaatttttttttttttttgatgcttgttttcttgtaaaaaatacagtcccccagatcgtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacgagattgagacttcctctaaaaaaaaaaaaaaaaaagaaagaaagaaaaaagttttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaacagttaaaatggtttggtcttaatgtgttatggaaactttacacctgtaatcccaggactttgggaggctgaggcgagaggatcacttgaggtcaggagtttgagaccagcctggccaacatggcgaaaccccgtctctactaaaagtacaaaaattagccaggtgtggtggtgcatgcctgtgatcccatctacttgggaggctgaggcaggagaatcgcttaaacctgggaggcggaggttgaagtgagcagagattacactactgcactccactccagcctaggcaacagagtgagactctgtctcaaaaaaaaaaaaaaaagaaaagaaaaaagaaaaagaaaaagcatgtacttttctacgaatttaattttgagaaataatcagacgtatgactaaagatatatttatcaaagtaatcactataatgttaaatattagattttaaaaagaacaaaagagtaaacaaccaaataaaaaccctttagatgtagggttacagaattgattatttgattgaactaaccatagtatatgcaagaagggtacaaattatagccattaaaacaccctgggtagctttatatgtattaacagttatatatcttggctgggcagggtggctcatgcctgtaatcccagcactttgggagaccgagagaggcagatggataaagcccaggagtttgagaccagcctgggcaacgtggtgaaactccatctctacaaaaaacaccaaaaaaaaaaaaaaaattagctggatatggtggcacaggcctgtagtcacagctactcagaaggttgaggtaggaggatcacctaagaaaggaggtctagactgcagtgagctgtgatcacgccactgcactccagcctgggtggcagaacaagactgtctcaaaaaaaaaaaagttatatggcttaatgttaaagtttccatagcacattaagaccaaaagcaggcacagaacagtatctatggtatgaatgtatttttgtgaaaaatttaaaaattcacatgtatataggcatacaattgaaggttacccaccacattaacatctgtagttcctatttctgagggcaggattatgaagagactttcccttaaacatttatgtactgtttgcatttttaacagtagattttaacaaggaaaaaaccatgaaggtatttcaattttttttctttttttttgagacagagtttcgctctgttgccgaggctagagtgcagtggcacgatctcggctcactgcaaccttcgcctcctgggttcaagcaattctcctgcctcagcctcctgagtagctgggattacagatgagtgccaccacacccagctaattttttgtatttttagtagagacagggtttctccatgttggccaggttgatctcaaactcctgacctcaggtgatctgccctcctctgtcccccaaagtgttgggattacaggcgtgagccaccgcgcccagccggtatttcaaatttgaaataattatttttacaatttct

SEQ ID NO: 92 - DNA, 2606 bp, Homo sapiens
ctatcaccgtatgtgtatgtgcacactgtcatgccaaataaaacacatttccattcaaggcagtagcaaaacagggttgccgattgtgtggctgaaaagcagtgcatgtcaccaactgtccctaactcacggtgagtgatccatccctgtgaccttgattttcacgatctttcatttttatttaccttttatcttttgtagagatgggttctcactatgttgcccaggctgatcttgaactcctgggatcgagcagtcatccctcctcggcctcccaagtagctgggactacaagctggcccagatataagcaggcagtttttaattttttttattattattttttgaaacgaactctctattgcccaggctggagtgcagtggcgcgatctcagctcactgcaacctccacctcccaggttcaagagattctcttgcctcagcctcccgagtagctgggattacagctacttggctgtacaccatgcccggctaattttgtatttttagtagagacggggtttcactatgttggccaggctgatctccaactcttgatctgctcacttcagcctcccaaagtgctgggattacaggcgtgagccaccgtgcccggctagagcaggcagtttaatgctgggctcccatagtggtaagtcttcagggtactgaaatttcgaatttagatttatttgttggtttgtgtgtttttctctattatataggctttagaaggacagaaatttgttctgtttttctcagtattccctgagcctaggacagtgcctgtacacatgggtaaaatgaataaactttttgggagaagggtatttttttttcttttgtcacaggctaattagaatgatgtcctttcactcagagaacacagccctcaggttcttctcttgtctattctggtgtcttgaatgccaatttgtcttcaaataattttgatgaatttcagctgatcaaccatcagatttttgtgtgtgtttccatataagaacacttaaatccagtgtgataaaagcaacttacaagcccgaggcttggaagaaaggaaaggaattttttacttcttgggctgaatacatttcatcacatcccaatttatttccctgaggcttttctttgtcaagcttgggaaagtgctgtttcctaggagaaccacacaagaacaaactttaaatatgagaaaagagaaaagcacaccccaaagcaaaacaaaacaaaaaaaacccccaaaaacaataagagaagcattttagatggattttctccaaagatcgattgcattgtgttccaaacgcatttcttttctttcttttttaaattttttttgagatgaagtttcactctgttacgcaggctgaggtgcagtggcatgatcttggctgactgcaacctccacctcctgggttcaagtgattctcccgcctcagcttttcaagtagcttcaggtgcccaccaccatgcctggctaattttgtatttttagtagagatggggtttcaccacgttggctaggctggtctcaaactcctgacctcaagtgatccacccgcctcagcctcccaaagtgctgggattacaggcgtgagtcactgtgcccagtgtaaagtgcatttcttttctaaactgacttgaaccaaaatggatgaacaaggacccttcagatgatatacaccaaactggaaacagatgagaatgccagcaaatgggctcaggaggaatttatcttcttgaattttcaggcataagctgattttgacaatgttttctcttacaaaaacagggtgagcgtgttctggatggaggctgggtgggaaccccaggtcagagcagatgtggaactggggcatggggaagactataccccaaagaggtgggggtggggaagaagatgaaaagtgaaagacgaatgttcccaggggcaggaattcataaactttttccattgattctgccctctcaagccaatcactttctgcctttttggaccaaattgggaaagcctggacagtctgctacaaaccagaccagagcctttccttgtcaacagagcagcgcttcctaaacttatactgcgttaaaaatcacatgggaatttgttaaaaatgcagtgtctggaggcctcctagaggttctgatttagttggtctgagtcagggtccaagaatttgtatccagagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctccctgaacaacttccacctccacctttcagctca
